United States Patent 11,098,302 (IDENTIFICATION OF POLYNUCLEOTIDES ASSOCIATED WITH A SAMPLE) - sequence listing, part 105

SEQ ID NO: 360546 - DNA, 721 bp, Homo sapiens
  misc_feature: GZ8MTXP02G9068.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaagttggggctgagcgttgggttttccttgttgcctattttagaaggttgtccagtgtgaggtgcagctggtggagtcgtgggggtaggtttggtccgaggtccggtcgggggtccctaggagtactcgttcgtggtcgccggtcctcgtggtattcactctactaactaaactgttaggatgagtcgtggtccgtcgaggtcctacggaggggacgggtcgtagggaggtggggtcgacgagctaagtacgggaaacggtagtaaggtaggaaacgtaaacaaaaagtacgttagtaggtacggtactcggttaggacgggaaacgggtcctagtaccaacctgtactccgaagaaccgaacgaaacccgaacaaaacgtaacctagaaaccttgtaccgttcgaacgtaaacgaaagtacgaaaaccgtaccgtaaacccgtaaacggaaccccgacgggtaaaactcccggtagttacggtagttaaccttaaaggtcggtacggaaaccggcgtaaaccggtaacccgtacggtaaccggggtccggggacccggttacccgaccggtttcgaacccccg

SEQ ID NO: 360547 - DNA, 701 bp, Homo sapiens
  misc_feature: GZ8MTXP02GIVZ9.2.16.B05.1.454.CMB.2.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccagccgtggggggtccctgagactctcgtgtgcggcctntggattcatctctaactaaactnttggatgagcgtgggtccgtcaggctccggaggggagggctgggaggtgggtcggccagcagtacggaaacggagacgtagggaaacgtacaaaaagtacgtagtggtaggtaacttcgtaggtacgggaaacggggtccctaagttcccaacgtaacttcccgtacgaacggaacgaaacccaaaccggaccaaaacgaaaccttaccaacgttgttaactcgtaagaactaaaagtcgaaactacgaaccgtaaaacgggacccgaagggaacctacgggtacttagggttaaggtttaactttacccggtgggtaacggaccggtaaggaaccggtaacccggtacccggttaacggggtccgggggaacccccgggtcgtaaccccggtcggggtttaaccccg

SEQ ID NO: 360548 - DNA, 613 bp, Homo sapiens
  misc_feature: GZ8MTXP02FWF92.2.16.B05.1.454.CMB.2.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (361)..(361): a, c, t, g, unknown or other
  misc_feature (361)..(361): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtcagtgtgaggtncagctgggtggagttcggtgggggtaggtttggtccgagccgtggggggtccctgagctctcgtgtgcggctntggattcatctatacaaatnttggatgagtcgtcgggtcctgacggctccggaggggaggggctgggaggtggggtcgcagcagtcggaacgngagtagggaaatacgaaaagtactagtaggtaggaccttgtaggtaggaaacggggtacctattaccaacctaatccctagaaacgaacgaactaaaccggaccaaaagaacctaccacttcgaattacgtcgaactaaatcgaaacgacgacccgtaaacgaccggtagacgacggtactgttagtacttacgtaggtcgacgaggaccaacgtactacgggaccgggggtcccgagccccgtaggtaccc

SEQ ID NO: 360549 - DNA, 760 bp, Homo sapiens
  misc_feature: GZ8MTXP02I0C3H.2.16.B05.1.454.CMB.2.raw
tcagacgctcgacacacgaccggtgctcgatttagagctcacgtattgggtttgaggtctcagagaggagccttagccctggactccaaggcctttccacttggtgatcaccactgagcacagaggactcaccatggaattgggctgagctgggttttccttgttgcctattttagaaggtgtccagtgtgaggtgcagcgtggtggagtcgtgggggtaggtttggtcagccggtgggggtcctgagactctcgtgtgcggcctcgtggattcatctactaacaactatggatgagcgtgggtccgtcgaggcgtccggaggggaacggggtcgtggggagggtggggtggaccgagcgagtaggaacggagagtaggaaagtaacgaaaaagtaactgttaggtacggtactcgttaggtaggaaacggggtacccgtaaattcccgaacctacttcccgtaccgaagaaaccgaacccgaaaaccggaacccgaaaaggtaaccttaccgtaaaccgtttagttaacttacccgttaagaaccctaaaaagttacgaaaacgtacccgaaaccgaaaacccggaaaccccgggaacggaaaccgtaaccgggtacgtttaggttaacggttttaaacgttaccggtaggttaccggaacgggtaacgtaaccggtaccggtaacccggttccgggggtaacccggggggaccccggggaaccggttcccccgggttacggtaccccgtttaccccgg

SEQ ID NO: 360550 - DNA, 628 bp, Homo sapiens
  misc_feature: GZ8MTXP02GCOQF.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctgggtggagtcgtgggggtaggtttggtccaggccgtgggggtccctgagactctcgtgtcgcggcctctggtattcatctctaacaaacttattggatgacgtcgtgggtccgtcgaggcctaccggaggggaagggcgtagggaggtggggtcgccagctagaggaacggagagtagggaaataacgaaaaagacgtagtaggtaggtactgtaggtagggacgggactactcactatccgtacgaagacgtaacaaccgacaaagaactacgacttagactactagaacctaaatacgaaacgtacgtaaccgaaaacggaccgaaacggtacacgggtactagtagttaacgttacgtggtacgacgagacgaaccggtcgtaacggccgggggacccggaccgtacccggtggtaaccccg

SEQ ID NO: 360551 - DNA, 653 bp, Homo sapiens
  misc_feature: GZ8MTXP02GF0E8.2.16.B05.1.454.CMB.2.raw
  modified_base (258)..(258): a, c, t, g, unknown or other
  misc_feature (258)..(258): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattgggctgagctgggtttcctgttgccatttagaagtgtccagtgtgaggtgcagctggtggagtcgtgggggagtttggtccagccgtgggggtccctgagctctcgtgtgcggcctntggattcatctctaacaaactattggatgagcgtgggtcctcgaggcctaccgaggggtaacggggcttgggaggttggggtcggacccaggacctagtcgggaaaccgggagagtagggaaagtaccaaaaagaccttaatagggtgtaccttcgtagggtaggaaacggggtcccgtaatttcccaacgtaatcccgtaaccgaaggaacgaacaaaccgccctaaaaagtacctacaaaccttggtaaacttccgtaggaactaaaacgtacgaaactagtaccccgaaagacccccggaagaccgtaacggtcgtagtacgttaattacggcgtacgacggacgaaccgtccgacgtccggggtacgggcccggacgtcccgtacggtacc

SEQ ID NO: 360552 - DNA, 718 bp, Homo sapiens
  misc_feature: GZ8MTXP02IZY2F.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgccattttagaaggtgtccagtgtgaggtgcagctggtggagtcgtgggggaggtttggtccaggccgtgggggtccctgagactctcgtgtgcggctctggattcatctctaacaaactattggatgagcgtgggtccgtcgaggctaccgaggggaaggggcgtgggaggtggggtggccgaggcagtaggaaacggagagtagggaaagtacgaaaaagacgtagtaggtaggtaactcgtaggtaggaaacggggtccctaattcccaaaccgtacttacccgttacccgaaaggaaccgaaaccgaaacccggacccgtaaaagaaccttaccaacttggtaaacttcgtacgaactaaaatacggaaaaccacggtaaccccgtaaaacggacccccgggaaagggaacccgtaacggggtacttacggggttaaacgttaacgtttaccgtagggtacggaacccgaaggaaaccggtaacccggtacgttaaccggggacccgggggggaccccggtaccggtccccggtaggggtttacccccg

SEQ ID NO: 360553 - DNA, 659 bp, Homo sapiens
  misc_feature: GZ8MTXP02GZCG3.2.16.B05.1.454.CMB.2.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (348)..(348): a, c, t, g, unknown or other
  misc_feature (348)..(348): n is a, c, g, or t
  modified_base (537)..(537): a, c, t, g, unknown or other
  misc_feature (537)..(537): n is a, c, g, or t
tcagacgctcgacacacgaccggtgctcgatttagagctcacgtattgggttttgaggtctcagagaggagccttagccctggactccaaggcctttccacttggtgatcagcactgagcacagaggactcaccatggaattggggctgagcttgggttttccttgttgcctattttagaaggtgtccagtgtgaggtncagcgtggtggagtcggtgggggtagtttggtccaggccggttgggggtccctgagactcgtcgtgtgcgctctggtatcatctctaacaaactnttggatgagcgttcgggtccgtcgaggctaccggaaggggacggggtctagggnggtggggtcgccgagcagtacggaacggagaagtagggaaaacgttacgaaaaagacgttagttaggtaggtaacttccgtaggtacgggaaacggggtacccgtatttaccaaccgtaacttcccaccgaaagaaccaacgaaccgacccaaaagacctaccgattacactttagacgtaacaaaaanaacgaaacgaacgaaccgaacgaaccgaacgaacgacgtacgtagttagtacgttagtacgtacgacgacgacgaaccgacggtacggtaccggggaccggaccggtcccgtaccggtaccg

SEQ ID NO: 360554 - DNA, 629 bp, Homo sapiens
  misc_feature: GZ8MTXP02HSKJV.2.16.B05.1.454.CMB.2.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (524)..(524): a, c, t, g, unknown or other
  misc_feature (524)..(524): n is a, c, g, or t
  modified_base (573)..(573): a, c, t, g, unknown or other
  misc_feature (573)..(573): n is a, c, g, or t
  modified_base (588)..(588): a, c, t, g, unknown or other
  misc_feature (588)..(588): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagcgtggnggagtcgtgggggtaggtttggccnggccggttggggggtccctggacgacttcgtcggttgtggccggtcctcgtggattcatctactaaactaaactagttggatgacgtgtcggggtccgtcgaggcctaccggagggggagggtcgtgggtaggtggggtggccgagcgagtacgggaacggagtagtaacggtaaagtaaaccaaaaagtactagttggtacggtcttacgtgggtaggaaacggggcctaattccgactactcacgaagacgaccaaccggtacaaacgtacctgaacttgtaacttcganaaccaagtacgaactaccgaacgaacggacccgagaccacggtctggtntaacgtcgtagcganacgcgaaccgtggacggtccggggccgtccgcgtcggtccc

SEQ ID NO: 360555 - DNA, 613 bp, Homo sapiens
  misc_feature: GZ8MTXP02GFBZ2.2.16.B05.1.454.CMB.2.raw
  modified_base (295)..(295): a, c, t, g, unknown or other
  misc_feature (295)..(295): n is a, c, g, or t
  modified_base (457)..(457): a, c, t, g, unknown or other
  misc_feature (457)..(457): n is a, c, g, or t
  modified_base (559)..(559): a, c, t, g, unknown or other
  misc_feature (559)..(559): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgcctattttagaaggtgtccagtgtgaggtgcagctggtggagtcgtgggggtaggtttggccaggtccggtggggggtccctggagactctcgtgtcgccggcctcgtggattcatctcctaacaactnttgatgagtcgttgggtccgtcgaggtcctaccggaaggggaacggggtcgtgggaggtgggtcggaccaggtcagtacggaacgagtataggaagtaccaaaagctataggtgacttcgaggtagacgggacgtatccacatcgtaccagacgacgaaacncgtaaacgactacacgtactatcacgactaaaatcggaactaacgacgtaaacgacccggaggaacacggtacgtgttaggtacttacgtagtacggtacgngaacgtaacccgtggtaccggtcggggacccggtacgtccccgtaggttccccg

SEQ ID NO: 360556 - DNA, 615 bp, Homo sapiens
  misc_feature: GZ8MTXP02FIDR2.2.16.B05.1.454.CMB.2.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (483)..(483): a, c, t, g, unknown or other
  misc_feature (483)..(483): n is a, c, g, or t
  modified_base (542)..(542): a, c, t, g, unknown or other
  misc_feature (542)..(542): n is a, c, g, or t
  modified_base (579)..(579): a, c, t, g, unknown or other
  misc_feature (579)..(579): n is a, c, g, or t
  modified_base (601)..(601): a, c, t, g, unknown or other
  misc_feature (601)..(601): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtcggtgggggtaggtttggtccaggtccgtggggggtccctggacgaccttctcgtgtgcggcctcgtggattcatctctacaaactntggatgagcgtggtccnaggctccggaggggagggctgggagnggggtgccagcagtacggaacggtagaagtaggaaagttacaaaaaaggtactagtggtaggaccgtctgggtagaacgggggtcctaaagttacccaacctatccgtaccaggacgaacaacgccaaagacctcactagtacncgtagaccaaagtacgaaacacgtaaccgaacggaccgaaggaccacggtctacggttnttaaacttacgtaggtcgaccggtagacgtaacccgnttaccggacgggggcccggacnccccgtaggtaccc

SEQ ID NO: 360557 - DNA, 717 bp, Homo sapiens
  misc_feature: GZ8MTXP02IKZO3.2.16.B05.1.454.CMB.2.raw
  modified_base (363)..(363): a, c, t, g, unknown or other
  misc_feature (363)..(363): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcctattttagaaggtgtccagtgtgaggtgcagctggtggagtcggtgggggtaggtttcggtccaggccggtgggggtccctggagtactcgtcggtgtggccggcctcgtgggtattcattctactaacaaactagttggatggagtcgtcgggtccgtcgacggccgtacggaggggtaaggggcgtagggnggttgggcggccgagacgtagtacggaacggagagtacgggaaaatacgaaaaagtaccgttagtaggtacggtaaccttcgtagggtaacgggaacggggtacctaacgttacccgtaaccaacttcccgttaacccgaagaaaccgaaaccgaaaccgaaaccgaaacgtaaacctaccgtaacgttacggtaacttacgtacgtaactaaaagtacgaaacgaacggtaaccgtaaacggacccggtaaacgacgtacggtacgtagttacgttacttacggtacgtacgcgtaacgacgtaacgaccgtacgggaccgggggaccgtaccggtacccgtacggtaccccg

SEQ ID NO: 360558 - DNA, 802 bp, Homo sapiens
  misc_feature: GZ8MTXP02HLW2Z.2.16.B05.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
tcagacgctcgacacacgaccggtgctcgatttagagctcacgtattgggtttgaggtctcagagaggagccttagccctggactccaaggtctttccacttggtgatcagcactgagcacagaggactcaccatggaattgggctgagcttgggttttccttgttgcctattttagaaggtgtccagtgtgagtgcagcgtggtggagtcgtgggggtagtttggccagccggtgggggtccctgacgctntcgtgtgcggcctgtgattcntctactacaaactnttggatgagtcgtggtccngagctacggagggagggcgtgggaggtggcgtaccaggctagacggaaaggnagtacggaaagtaaacaaaagtacgtaagtggtacggtacttacggaggtaacggtacgggggtacccttagttaccccaaaccggttaactccccgaaccggaaaaggaaccgtaaaacccgaaaccccggtaacccgtaaaaacgtaacccttaccggaaacctttagttaaaccggttaccgttaaaccgaaaaccgttaaaaacgtaaaccgtaaacccggtaaacccggtaaacccggtaaaccccgggtaaaaccccgggtaaaccgggtaaaacccggtaaaccgggtaaccggttacggtttaacggttaaacggtttaacggttacggttacggtaccggtaaccggtaaccggtaacccgggtacccgggttacccgggggtacccgggggtaccccggggtaccccggtaccccggttacccgggttaccccg

SEQ ID NO: 360559 - DNA, 681 bp, Homo sapiens
  misc_feature: GZ8MTXP02JYNPM.2.16.B05.1.454.CMB.2.raw
  modified_base (341)..(341): a, c, t, g, unknown or other
  misc_feature (341)..(341): n is a, c, g, or t
  modified_base (621)..(621): a, c, t, g, unknown or other
  misc_feature (621)..(621): n is a, c, g, or t
tcagacgctcgacacacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcctattttagaaggtgtccagtgtgaggtgcagcgtggtggagtcgtgggggtaggtttggccagccggtcgggggtccctgagctctcgtgtgcggcctgtggattcatctctaacaaacttgttagatagagtcgtgggtccgtcgacggctaccggaggggagggtcgngggtaggtggcggccagcgagtacggaacggagtacgtaggaaacgtaacgaaaagacgttagtaggtaggtacctacgtagggtacgggtaaacggggtacccgttaacttacccgtaaccgtactacgtacccgaaaggtaccgaaaccctaaaccgacccgaaaagtaccctaccggtaaacttggtaacctacgttaggaaacctaaagtaccgaaaccgaacgtacccgtaaacgacccggacggtacaacggttcgtaggttatacttcggtancgggaacgacgcgtaacccgtcgtaccgggtccgggggcccaccggtccgtacgtacccg

SEQ ID NO: 360560 - DNA, 670 bp, Homo sapiens
  misc_feature: GZ8MTXP02GHH21.2.16.B05.1.454.CMB.2.raw
tcagacgctcgacacacgaccggtgctcgatttagagctcacgtattgggtttgaggtctcagagaggagccttagccctggactccaaggcctttccacttggtgatcagcactgagcacagaggactcaccatggaattgggctgagctggtttcctgttgccatttagaaggtgtcagtgtgaggtgcagctggtgagtcgtgggggtaggtttcggtccagccgtgggggtccctgagctctcgtgtgcgcctcgtggatcatctctaactaaactattggatgagcgtggtcgtcgaggccgtacggaaggggacggggctagggacggtggggtcgccaggctagtacgggaaacggagtacgtagggaaataaccgaaaaagtactagtacggtaggaccttgtaggtagggaaacgggccgtaacttcccgaactacttacgacccgaaggtaccgaaccgaaacccgacctaaaacgaaccttaccgtacttaacgtacttaccgacgtaaaccaaaagtaccgaaaactaccgggaaccctaaaacggaccccgggtaagaccgtaccggacttacggttacgttacttacggtcggacgtacggaagaccgaaccgtacggaacggtccgggggacccggacgtcccggtcgtaccccg

SEQ ID NO: 360561 - DNA, 526 bp, Homo sapiens
  misc_feature: GZ8MTXP01DPAZJ.52.55.E11.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (386)..(386): a, c, t, g, unknown or other
  misc_feature (386)..(386): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagcccaccctctcctgcagggccagtcagagtgttggcaactntagcctggtaccaacaaaactgcagctccagctctcatctatgatgcatccacgaggccactggcatcccagccaggttcagtggcagtgggtctgagacaagacttcactctcaccatcagtcgcctgagcctgaagtnttttgctagtttatactgtcagcagcgtagccactgctctcgtttcgggcggtagggacctaagggttcgaagtaattacgaaaacgttacgtggtcggacttgaccaacctatcttgtcttactaacgttccttccccg

SEQ ID NO: 360562 - DNA, 487 bp, Homo sapiens
  misc_feature: GZ8MTXP01BXFFQ.52.55.E11.1.454.CMB.2.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgttggcaacctnttagcctgaccaacaaaactgcagctccagctcncatctatgatgcatccacgaggccactggcatcccagccaggttcagtgcagtgggtctgagacaagacttcactctcaccatcagtcgcctgagcctgaagtattttgctagtttatactgtcagcagcgtagccatgctctnttcgggngtagactaggtgaatnanaaacgagtgngcttgcaacntctgtcttctcgttcgtcc

SEQ ID NO: 360563 - DNA, 535 bp, Homo sapiens
  misc_feature: GZ8MTXP01BBACK.52.55.E11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaactnttagcctgtaccaanaaactgcagctccagctcncatctatgatgcatccacgagggccacgtgcatcccagccaggttcagtggcagtgggtctgagacaagacttcactcncaccatcagtcgcctcgagcctagaagtnttttgcttagtttatactgtcagtcagggcgtagccagtggctcgtcgtttcgggcggtagggacctaaggttgaagtattacgaaacgacgtggtcgggccttggcctaaccgttcttcgttcgttcttactaacgttcccgtcccg

SEQ ID NO: 360564 - DNA, 500 bp, Homo sapiens
  misc_feature: GZ8MTXP01DIKQ6.52.55.E11.1.454.CMB.2.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccacctctcctgcagggccagtcagagtgtgcaactntagcctgacaacaaaactgcagctccagctctcatctatgatgcatccacgagggccactggcatcccagccaggttcagtggcagtgggtctgagacaagacttcactctcaccatcagtggccctgagcctgaagtatttgctagtttatactgtcagcaggctagccacgtggctctcgtttcgggcggtagggaccaaggttgaagacttacaaacgagtgtggcttggcaacntctntcttctcgttctccg

SEQ ID NO: 360565 - DNA, 548 bp, Homo sapiens
  misc_feature: GZ8MTXP01DIZ3S.52.55.E11.1.454.CMB.2.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttgcaactcttagcctggtaaccaaacaaaacctggccaggctcccaggctcctcatctatgatgcatccacgagggccactggcatcccagccaggttcagtgcagtgggtctgagacaagtacttcactctacaccatcagtcggcctgagtcctagaagtnttttgacttagttttatactgtcagcaggcgtagcctacgtgtctcgttcgtttacgggcggtaagggtaccaagggttgaagtacttaacaaaacggactggtagccgttgacctaactatcgttgtcttctaacttcctaacccg

SEQ ID NO: 360566 - DNA, 533 bp, Homo sapiens
  misc_feature: GZ8MTXP01A74LS.52.55.E11.1.454.CMB.2.raw
  modified_base (204)..(204): a, c, t, g, unknown or other
  misc_feature (204)..(204): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaactcttagcctggtaccaacaaaacctggccaggctcccaggctcctcatctatgatgcatccacgagggccactggcatcccagccaggttcagtggcaggtgggtctgagcaagacttcactctcaccatcagtcgcctgacgcctagaagtattttgcttagtttatactgtcagcaggcgtagccagtggctcgtcgtttcgggcggtagggacctaagggttgaaggtattacgaaagacgtggtgcgttggactaaccagttctgtcttctaacttccgtccccg

SEQ ID NO: 360567 - DNA, 550 bp, Homo sapiens
  misc_feature: GZ8MTXP01BF9SM.52.55.E11.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccaccctgtctttgtctccgagggggganacgccaccctctcctgcagggccagtcagagtgttggcaactnttagcctggtaccaaacaaaactggaccaggctcccaggctcctcatctatgatgcatccgacgagggccacgtggcactcccagccaggttcagtggctaggtgggtctgagacaagtacttcactctcaccatcagtcgcctgagtcctagaaagtcttttagcttagtttatactgtacagcaggtcgtagcctacgtggtcctcgtcgtttcgggcggtaggacctaaggttgaagattacgaaacgacgtggtcggcttcggctaacctagttctgtcttctaacttccgttaaccccg

SEQ ID NO: 360568 - DNA, 571 bp, Homo sapiens
  misc_feature: GZ8MTXP01EEIIY.52.55.E11.1.454.CMB.2.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgtgcactntagctgacaacaaacngcagcncagcncnatcatgatgnatcagnggcangcatccagcagttcagtgcagtggtctgagacaagacttcactctcaccatcagtcgcctgagcctagaagtattttggacttagtttacttactgtacagcagggcgttaacgcctacgttgggcccttcgttccgtttcggggcgggtaacggggtaacctaaaggggtttgaaagggtaacttaaccgaaaaaccggttaacgttgggttaacgggcttcggacccaaccctatttccgttcggttccttaccttaaccgtttcccgtttcccccg

SEQ ID NO: 360569 - DNA, 559 bp, Homo sapiens
  misc_feature: GZ8MTXP01DANLF.52.55.E11.1.454.CMB.2.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctccgaggggganacgccaccctctcctgcagggccagtcagagtgtgcaacctntagcctggtaaccaaacaaaacctggaccaggctcccagctctcatctatgatgcatccgacgaggcccactggcactcccagccagttcaggtgcaggtggctgagacaagcttcactctacacatcagcgcctgacgtcctagaagttatttaggacttagtttaacttactgtacagtcaggtcgtancctacgnggtcctcgttcgtttcgggcggtagggacctaagggttgaagtaagttaccgaaaacgcgttaggcggttcttcgacctaacctagttcgtcgttcttactcgttaacccttccccg

SEQ ID NO: 360570 - DNA, 515 bp, Homo sapiens
  misc_feature: GZ8MTXP01AHNTW.52.55.E11.1.454.CMB.2.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (505)..(505): a, c, t, g, unknown or other
  misc_feature (505)..(505): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagcccaccctctcctgcagggccagtcagagtgttggcaacctcttagcctggtaccaacaaaacctggccaggctcccaggctctcatctatgatgcatccacgaggccactgcatcccagccaggttcagtgcagtgggtctgagacaagacttcactctacaccatcagtcggcctcgagcctgaaagtntttgctagtttatacngtcagcaggctagccacgtgctctcgttcggnggtagggaccaaggttgaagattacaaacgactggtacgcttgacaaccatctgtcttctnttccttcccg

SEQ ID NO: 360571 - DNA, 530 bp, Homo sapiens
  misc_feature: GZ8MTXP01CK6V3.52.55.E11.1.454.CMB.2.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (282)..(283): a, c, t, g, unknown or other
  misc_feature (282)..(283): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (506)..(506): a, c, t, g, unknown or other
  misc_feature (506)..(506): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccacggagaagttgtattgacacagtctccagccaccctgtctttgtctccgagggggganagcccaccctctcctgcagggccagtcagagtgtgcactntanctgacaanaaacngcagcnccngcncnntnatnatnnatcagnggcacngcatcccagccagttcagtgcaggtggtctganacaagacttcactctacacancagtcggcctggactcctagaagtattttgacttagtttactactgtacagtccgaggtccgttaagcccctagtcggaccttccgttcggtttacggggcggaacgggtaccgtaagggttcgaagtacttacgaaacgacgtggtggacttgacncatctgtcttctaacttcctcccg

SEQ ID NO: 360572 - DNA, 559 bp, Homo sapiens
  misc_feature: GZ8MTXP01EAOLL.52.55.E11.1.454.CMB.2.raw
  modified_base (204)..(204): a, c, t, g, unknown or other
  misc_feature (204)..(204): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccacctctcctgcagggccagtcagagtgttggcaacctcttagcctaggtaaccaaacaaaacctggccaggctcccaggctcctcatctatgatgcatccacggagggcccagtggcatccccagccaggttcaggtgctgtagggtctgagacaagacttcactctacacatcagtcgcctgagctagaatatttgactagtttatactgtcaagcagggcgtagcctagtcggtccttcgttcgtttacggggcggtaacgggacctaagggttgaaagtattaacgaaaacgttacgtggtcgggttacttggcccaactatcttgtcttctaacgttccgttccccg

SEQ ID NO: 360573 - DNA, 616 bp, Homo sapiens
  misc_feature: GZ8MTXP01AS0N0.52.55.E11.1.454.CMB.2.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctccgaggggganagccacctctcctgcagggccagtcagagtgttggcaacctcttagcctggtaccaaacaaaacctggccaggctcccaggctcctcatctatgatgcatccacgacggccacgtggcatcccagccaggttcagtgcaggtggtctgagacaagtacttcactctacaccatcagtcggcctgagcctagaatnttttgacttagtttacttactgtacctagccagggtccgtaagcccgtacgttgggtcccttcgttccggtttcggggaccgggtaacggggtacccgtaaaggggtttgaaacgggtaacttaaccgaaaaccggttacgttagggtcggttccgttggacccaaccggtacttcctttcgggttccctttacgtaaccttttcccgttaaccccccg

SEQ ID NO: 360574 - DNA, 522 bp, Homo sapiens
  misc_feature: GZ8MTXP01BNJS8.52.55.E11.1.454.CMB.2.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (322)..(322): a, c, t, g, unknown or other
  misc_feature (322)..(322): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccaccctgtctttgtctccgaggggganagccacctctcctgcagggccagtcagagtgtgcaactntagctgacaacaaacngcagcncagcncnatcatnatgcatcacgnggcactgcatcccagccagttcagtggcagtggtntgagacaagacttcactctcaccatcagtcgcctganctagaagtnttttagacttagtttatactgtcagcagggcgtagccacgtggccttcgtcgttacgggcggtaacggggtacctaagggttgaaagtacttaacgaaacgacgtgtacggcttggacctaacgtattcgttgtccttactcttccgttccccg

SEQ ID NO: 360575 - DNA, 593 bp, Homo sapiens
  misc_feature: GZ8MTXP01B4KU5.52.55.E11.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (552)..(552): a, c, t, g, unknown or other
  misc_feature (552)..(552): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganacgcccacctctcctgcagggccagtcagagtgtggcaacctntagcctgtaccaacaaactgccaggctccagctcncatcatgatgcatccgacgacggccacgtggacactcccgagccgtaggttccaggtggccgtaggtcgggtntaggagactaaagtaccttcaacttcctaccacctatcgagtcgccctgactcctgaacttgtttgacttagtttactactgtacagcagggcgtagccacgtggtcttcgtcgtttcgggacggtacgggtaccgtaagggtcgaaagtacgttaacgtaaaacgacgttgggtcgttacgttcgaccctaaccgtnttccgttacgttccttacctaaccgtttcccgttaaccccg

SEQ ID NO: 360576 - DNA, 581 bp, Homo sapiens
  misc_feature: GZ8MTXP01CYFWZ.52.55.E11.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (389)..(389): a, c, t, g, unknown or other
  misc_feature (389)..(389): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctcgagggggganagcccaccctctcctgcagggccagtcagagtgtgcaactntagctgtacaacaaacngcagcnccagcnctcatctatgatgcatccacgagggccacgtggaccagtccccagccgaggttcaggtggcaggtgggtctgagacaacgtacttcactctacaacctatcgagtcggcctcgganccgtagtaaagtagttttagacttagtttactaacgtgtacagtcagggtcgttaggccctacggtgtcctcgttcgtttaccggggcggtaacggggacctaagggtttagaacgtaagttaacgaaaacgttaacgtggtacggttcttcgacctaacgtattctcgtcttctaacttccgttaaccccg

SEQ ID NO: 360577 - DNA, 586 bp, Homo sapiens
  misc_feature: GZ8MTXP01AD9FO.52.55.E11.1.454.CMB.2.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctntagcctggtaccaacaaactgcaggctccagctctcatctatgatgcatccacgagggcccactggcactcccagccaggttcagtggcaggtggctgagacaagacttcactctcacatcagtcgccctgagcctagaagttattttacggcttagttttatactgtacagtcaggggtcgtacgccacgttcggccttcgttcgtttcggggacggtacgggtacctaaagggttcgaaagtacgttacgaaaaccgttagttcgggtaggccttgggaccctaacccgtattccgttcggttcctttaccgtaacgttttccccgttaaccccgg

SEQ ID NO: 360578 - DNA, 516 bp, Homo sapiens
  misc_feature: GZ8MTXP01BC5AO.52.55.E11.1.454.CMB.2.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(282): a, c, t, g, unknown or other
  misc_feature (273)..(282): n is a, c, g, or t
  modified_base (286)..(286): a, c, t, g, unknown or other
  misc_feature (286)..(286): n is a, c, g, or t
  modified_base (289)..(290): a, c, t, g, unknown or other
  misc_feature (289)..(290): n is a, c, g, or t
  modified_base (293)..(294): a, c, t, g, unknown or other
  misc_feature (293)..(294): n is a, c, g, or t
  modified_base (297)..(298): a, c, t, g, unknown or other
  misc_feature (297)..(298): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (307)..(308): a, c, t, g, unknown or other
  misc_feature (307)..(308): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagcccaccctctcctgcagggccagtcagngtgttgcactntagctgacaacaaacngcngcncngcncnnnnnnnnnncagngcnngcnnccnncngtngtgnngtggntgananagactcactctcacatcagtcgcctgagctagaatnttttgacttagtttatacttgtcagcaggtcgtacgcctacgtcggcttcgttcggtttcggggacggtacgggtaacctagggttgaagtacttacgaaacgttacgtggtagcttggcctaacctgttcgttcgttccttctaaccgtttcccgtcccg

SEQ ID NO: 360579 - DNA, 600 bp, Homo sapiens
  misc_feature: GZ8MTXP01A9L3J.52.55.E11.1.454.CMB.2.raw
  modified_base (204)..(204): a, c, t, g, unknown or other
  misc_feature (204)..(204): n is a, c, g, or t
  modified_base (565)..(565): a, c, t, g, unknown or other
  misc_feature (565)..(565): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaactcttagcctggtaaccaacaaaactgccaggctcccaggctcctcatctatgatgcactccacggaggccactggacactccccagccgaggttccaaggtggacgtaggtggggtctggagacaagtaccttcacttccacaccgatcgagtcgcctacgagtcctagaacgttagttttgactttagtttacttacgtgtacagtcacggggtcgtacgccctagtcgtctcgttcggtttccgggacgggtacgggtaccgtaagggttgaacgtacgttaacgaaacgttacggtgttacgggcttggaccaactnttcgttacgtcttactaacgttcccgttaaccccg

SEQ ID NO: 360580 - DNA, 554 bp, Homo sapiens
  misc_feature: GZ8MTXP01D5232.52.55.E11.1.454.CMB.2.raw
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccaccctgtctttgctccgagggggganagccaccctctcctgcagggccagtcagagtgttgcaactcttagcctgtaaccaacaaaactgcagctccagctcncatctatgatgcatccacgaggccatggcatcccagccaggttcagtggcaggtgggtctgacgacaagacttcactctacacatcagtcgcctcgancctagaagtnttttagcttagtttatactgtacagtcaggtcgtaagcctacgttcggcttcgttcgttacgggcggtaagggtacctaagggttcaaagtacttaacgtaaaacgttacgtggtcggcttcggactaacctatcgttcgtcctttaccaacgtttcccgttccccg

SEQ ID NO: 360581 - DNA, 560 bp, Homo sapiens
  misc_feature: GZ8MTXP01B4PYK.52.55.E11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (360)..(360): a, c, t, g, unknown or other
  misc_feature (360)..(360): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaactnttagcctggaccaacaaactgcagctccagctctcatctatgatgcatccacgagggccacgtggcatcccagccaggttcaggtgcagtgggtctgagacagacttcactcncacatcagtcgcctgagcctagaagtattttagctagttttactacgtgtacagcaggtcgtagcctacgtggccttcgttcgtttcggggcgggtaggtaccgaagggttcgaagtacttaaccgaaacgttacgtttcgggcttacggccttaaccctaattcccggttcgttccttcttaccttcccgttccccgtc

SEQ ID NO: 360582 - DNA, 629 bp, Homo sapiens
  misc_feature: GZ8MTXP01AT8AH.52.55.E11.1.454.CMB.2.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccacggagaagttgtattgacacagtctccagccacctgtctttgtctccgaggggganacgcccaccctctcctgcagggccagtcagngtgttgcaactntagcctgtaccaacaaacngcagcnccagctcnatctatgatgcatccacggcgggcctacgtggccactcccagccgtaaggttccaggtcggctaggtgggtctggacgacaacgtacttcactcctaccacctatcgagtcggacctcgacggtcctagtaaacgttagttttcgacttaaggttttacttacgttcgttaccaggtaccgtaaggggtcgttaacggtcccacggttcggtcccttcgtttcggtttaccggggacggggtaacgggaaccgttaagggttgaacggtaacttaccgaaaacggttacgtgggtacgttccgttgaccctaacctattccgtacgttcttacctaactttcccgttccccg

SEQ ID NO: 360583 - DNA, 589 bp, Homo sapiens
  misc_feature: GZ8MTXP01EQMVQ.52.55.E11.1.454.CMB.2.raw
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggcctcccagataccaccggagaagttgtattgacacagtctccagccacctgtctttgctccgagggggganagcccacctctcctgcagggccagtcagagtgttggcaactcttagcctagaaccaacaaaactgcagctccagctcncatctatgatgcaactccgacgacgggccacgtcggacacgtccccagcccgtaggttccaggttcggcgtaggtcggggtactggaacggactaacgtaactttccaacttcctaccacccgtataccgaggttcgggacctcggaacgccgtagtaagttatttttggactttaagtttattactgtcagtcagggtcgtagccagtgcctcgttcggttcgggcgggaggtaccgtaagggtcgaagtaacttacgaaacgttagtgtacggcttcgacttaacntctntcttctcgttcctccg

SEQ ID NO: 360584 - DNA, 595 bp, Homo sapiens
  misc_feature: GZ8MTXP01B29KZ.52.55.E11.1.454.CMB.2.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
  modified_base (397)..(397): a, c, t, g, unknown or other
  misc_feature (397)..(397): n is a, c, g, or t
  modified_base (560)..(560): a, c, t, g, unknown or other
  misc_feature (560)..(560): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgccaccctctcctgcagggccagtcagagtgttggcaacctnttagcctaggtaaccaaacaaaactggccaggctcccaggctctcatctatgatgcatccacgaggccactggcactccccagcctaggttccaggtggcaggtgggtctgagacaagacttcactctacaccatcagtcgtcctgacnctgaagtattttgctaatttactatgtcagcagggtcgtagaccctagtcggtccttccgttcgtttccgggggacggtaacgggggtaacccttaaagggggttagaaacggtaacgttaaacgtaaaacgttacgtgggtacggcgttcgaccctaacgtnttccgttcgttccttacctaacgttcccgttcccg

SEQ ID NO: 360585 - DNA, 518 bp, Homo sapiens
  misc_feature: GZ8MTXP01CCSSZ.52.55.E11.1.454.CMB.2.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (276)..(278): a, c, t, g, unknown or other
  misc_feature (276)..(278): n is a, c, g, or t
  modified_base (281)..(282): a, c, t, g, unknown or other
  misc_feature (281)..(282): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (300)..(301): a, c, t, g, unknown or other
  misc_feature (300)..(301): n is a, c, g, or t
  modified_base (319)..(319): a, c, t, g, unknown or other
  misc_feature (319)..(319): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgtgcactntagctgacaanaaactgcagcncngcncnntnnnatnnancagnggcatgcatccnncagttcagtgcagtggtntgagacaagcttcactctcacatcagtcgccctgacgtcctagaacgttattttgacttagtttatacgtgtacagctaggcgtacgccacgtcggcttcgtcgtttcgggcggtagggacctagggttcgaagtacttacgaaacgttacgtggtggcttgcctaactagtcttcgtcttctaacgttcccttccccg

SEQ ID NO: 360586 - DNA, 551 bp, Homo sapiens
  misc_feature: GZ8MTXP01CERZ5.52.55.E11.1.454.CMB.2.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccacctctcctgcagggccagtcagagtgtgcactntagctgacaacaaacngcagctccagctcncatctatgatgcatccacgnggccacgtggcactcccagcctaggttcagtggcaggtgggtctgagacaagacttcactctacacatcagtcgcctgacgcctagaagttatttcgacttagtttactaccgtntacgagtccaggggtcgtacgcctacgtcggtccttcgttcgtttcgggacgggtaacgggtacctaagggttgaacgtacttacgaaaacgacgtggtcgcgttcgactctatcgttatccttactaacgttcctaaccccg

SEQ ID NO: 360587 - DNA, 666 bp, Homo sapiens
  misc_feature: GZ8MTXP01A6RVG.52.55.E11.1.454.CMB.2.raw
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccacggagaagttgtattgacacagtctccagccacctgtctttgtctcgaggggganagcccacctctcctgcagggccagtcagagtgttggcaacctnttagcctaggtaaccaaacaaaactggccaggcctcccaggcctcctcatctatgatgcactccgaacggacgggccacgtcggccactcccagccgtaggttcaggtggcgtaggtgggtctaggacgacgaagtaccttcgacttcaccaccatcgacggtcggccctacgacgtccgtagtaagttattttacggactttagttttactacgttgtacgagtaccgtaggggtcgttacggcctacggttcggtcctttccggtttcgttacgggggacgggtaacgggtaaccggttaaggggttagaaacggtaaacgttaaccggtaaaacggttagttcgggtaccggttacgttccggaccaacccgtttacgttccgtttcgttaccttacctaaccgtttcccgttaaccccg

SEQ ID NO: 360588 - DNA, 622 bp, Homo sapiens
  misc_feature: GZ8MTXP01DKAP9.52.55.E11.1.454.CMB.2.raw
  modified_base (204)..(204): a, c, t, g, unknown or other
  misc_feature (204)..(204): n is a, c, g, or t
  modified_base (417)..(417): a, c, t, g, unknown or other
  misc_feature (417)..(417): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctcttagcctggtaaccaaacaaaacctggccaggctcccaggcctcctcatctatgatgcatcccacggaggccacgtcggacactcccagcctaggttcaggtggcaggtcgggtactgagacaagtacttcactctacaccatcagtcggcctcgagtcctagaagttnttttaggacttaggttttactacgttcgtacagtaccgtaggggtcgttaacgccctacgttcggtcccttcgttccggtttccgggggacggtacggggtaacctaaggggttcgaagtaacgttacgaaaacggttacgttgggtacgggttcttcggacctaactagttccttggttccttacctaacgttccccttccccg

SEQ ID NO: 360589 - DNA, 655 bp, Homo sapiens
  misc_feature: GZ8MTXP01BKBTR.52.55.E11.1.454.CMB.2.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgctccgagggggganagccaccctctcctgcagggccagtcagagtgttgcaactctagcctgtacaacaaacngcagcncagctcnatctatgatgcactccacggaggcccacgtcggcactccccagccaggttcaggtcggactacggtggtctagaacgacaaagtacctttcactctacacctatcgagtcgggcctagacgtccgtgtaaagttcgttttcggactttaggtttttaacttaacgttcgtacgtacgcgtaaacggggtccgttaacgggaccctacggttgggccctttccgttccgggtttttaccggggaccggggtaaaggggtaacccgtaaggggtttacgaaacgggttaacttacgggaaaaccgttagtcgggttaacgggccttaggccctaacttaacgtcttccggttacttcctaaccgtttcccctttaaccccgg

SEQ ID NO: 360590 - DNA, 633 bp, Homo sapiens
  misc_feature: GZ8MTXP01DEL03.52.55.E11.1.454.CMB.2.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctccgagggggganagccacctctcctgcagggccagtcagagtgttggcaacctcttagcctggtaaccaacaaaactgccaggctccaggctcncatctatgatgcatccacgagggccactggcatcccagccaggttcagtggcaggtggtctgagacaagacttcactctcaccgatcagtcggcctcgacgtcctagtaaaggtattttcggacttaagttttattaacttgttacaagtccgaagggtccgttaagcctaacgttgggccttccgttcgttttaccggggcggtaacgggggtaaccctaaaggggtttcggaaacggtaacgttaccgaaaaacccggttacgttaaggttcggggactttcgggaaccctaacccgtaaatttcccggtttggttcccttacgtttcccttccggttttcccccg

SEQ ID NO: 360591 - DNA, 591 bp, Homo sapiens
  misc_feature: GZ8MTXP01ACGIP.52.55.E11.1.454.CMB.2.raw
  modified_base (205)..(205): a, c, t, g, unknown or other
  misc_feature (205)..(205): n is a, c, g, or t
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggcctcccagataccaccggagaagttgtattgacacagtctccagccaccctgtctttgtctccgagggggganagcccaccctctcctgcagggccagtcagagtgtggcaacctnttagcctggtaaccaacaaaacctggccaggctcccaggctcctnatctatgatgcatccacgaggccactggcactcccagccaggttcagtgcagtggctganacaagacttcatctcaccatcagtgcctgacnctagaagtattttgacttagtttactatgtcagcagggcgtagccctacgtggcctcgttcgtttacgggcggtaagggtaccctaaagggtttggaaatacgttaaccgaaaaaccggttacgtttggaacgggttcttacgggaccaaaccccgtttacgttccgttcgttacccgttacctaacccgtttccccgttaacccg

SEQ ID NO: 360592 - DNA, 622 bp, Homo sapiens
  misc_feature: GZ8MTXP01A2OK8.52.55.E11.1.454.CMB.2.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (358)..(358): a, c, t, g, unknown or other
  misc_feature (358)..(358): n is a, c, g, or t
  modified_base (406)..(406): a, c, t, g, unknown or other
  misc_feature (406)..(406): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagngtgttgctaactctagcctaggtaaccaacaaaactggcaggctcccagctcctcatctatgatgcatccgacggacggccacgtggcactcccagccgtaggttcagtggctaggtgggtcngagacaagtactcactctcacatcagtcgcctgacgcctagaacgttnttttacggctttagtttactacgtgtacctagcgtagggtacgttacgcctacgttgtccgttcgttacggttccggggacgggtaagggtacccgtaaagggttcgaacggtaacgttaaccgggtaaacgttaacggttcggtaggggttaccttcgggaccctaacttctccgtttaacggttcccttacgttaaccttccccggtttccccg

SEQ ID NO: 360593 - DNA, 570 bp, Homo sapiens
  misc_feature: GZ8MTXP01AOVMV.52.55.E11.1.454.CMB.2.raw
  modified_base (202)..(202): a, c, t, g, unknown or other
  misc_feature (202)..(202): n is a, c, g, or t
  modified_base (517)..(517): a, c, t, g, unknown or other
  misc_feature (517)..(517): n is a, c, g, or t
  modified_base (531)..(531): a, c, t, g, unknown or other
  misc_feature (531)..(531): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctccgaggggganacgccaccctctcctgcagggccagtcagagtgttggctaactcttagcctaggtaaccaaacaaaacctggaccaggctcccaggctcctcatctatgatgcatcccacggacgggccacgtggcactccccgagccgtaggtttccaggtcggacgtacgggtcggggtactaggaacgacgaacgtacctttcaccttcctacacctatcgacggtcggccctcggactccgtagtaagttattttggacttagtttactactgtcagtcaggcgtagccagtgctcgtcgttcggcggtaggtactaggtnaagattcgaaacgngtgtgcttgcctaactgtctgtcttctaacgttcctccg

SEQ ID NO: 360594 - DNA, 597 bp, Homo sapiens
  misc_feature: GZ8MTXP01AXRK7.52.55.E11.1.454.CMB.2.raw
  modified_base (203)..(203): a, c, t, g, unknown or other
  misc_feature (203)..(203): n is a, c, g, or t
  modified_base (533)..(533): a, c, t, g, unknown or other
  misc_feature (533)..(533): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganacgcccaccctctcctgcagggccagtcagagtgttggctaactctagcctagtaaccaaacaaaactggaccaggctccaggctcctcatctatgatcgcactccacggaggccacgtggacactccccgagtccgtaggttcaggtggccgtaggtggtctaggacgacacgtaccttcgactcacacctatcgagttcgccttgacgtaccgtaggtaattagttttacgacttaaggttttactacgttgtaccgagtcaggggtcgtacgcctacgtcggtccttcgttcggttacgggacggtaggaccgtaaggtgaacgtanacggaaaacgttcgtaggtcgcgttcgcctaactgtcggtctcttactccgttccgtaaccccg

SEQ ID NO: 360595 - DNA, 684 bp, Homo sapiens
  misc_feature: GZ8MTXP01C13FD.52.55.E11.1.454.CMB.2.raw
  modified_base (204)..(204): a, c, t, g, unknown or other
  misc_feature (204)..(204): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagagtgttggcaactctagcctaggtaaccaacaaaacctggaccaggcctcccaggcctcctcatctatgatgcactccgacggacgggcccaactcggaccactccccgaagccgtaggttcgaggttggcgtaggttcggggtctggacgactaacgtacttccgactccgtacacctatcgtaggttcggccctcggtacgtccgttaggtaagtttaagttttcgaacgtttaggttttaacttacgttcgtactaggtaccgaacggtcggggttaacctacccgtacggttcggtccctttcgttccgggtttaccgggggaccgggtaaaggggtaccctaaggggtttacgaaacggtaacttaaacggtaaacgttacgttcgggtcggttcttcggacctaaccttattcgttacgttcttactaaccgttccccttcccg

SEQ ID NO: 360596 - DNA, 553 bp, Homo sapiens
  misc_feature: GZ8MTXP01D5LGO.52.55.E11.1.454.CMB.2.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccacggagaagttgtattgacacagtctccagccaccctgtctttgtctccgaggggganagccacctctcctgcagggccagtcagagtgttggcaactntagctgaccaacaaaacngcagctcagcncnntctangatgnatcacgaggccatgcatcccagccaggttcagtggctaggtggtctgagacaagacttcactcctacaccatcgaggtcgcctcggatccgtagtaagttattttggacttagtttactacgtgtacagtctaggggcgttacgcctacgtcggtcttcgtcggtttacgggcggggtaacggtaccgtaagggttgaacggtaacttacgaaaacgttacgtggtagcgttcgactaacctatcttcgtcttactcttcccgtaaccc

SEQ ID NO: 360597 - DNA, 653 bp, Homo sapiens
  misc_feature: GZ8MTXP01EVIY1.52.55.E11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagcgcagtacgacacgaccggtgctcgatttagcactcgcacgttggggtttgggggaggaactgctcagttaggacccagagggaaccatggaagccccagctcagcttctcttcctcctgctactctggctcccagataccaccggagaagttgtattgacacagtctccagccacctgtctttgtctccgagggggganacgcccaccctctcctgcgagggccagtcagagtgttgcactntagctgaccaacaaactgcagctccagctcncatctatnatgcatccacggaggccactggcactcccagccaggttcaggtggcgtaggtgggtctaggagacaacgtaccttcactcncaccatcgagtcgcctgagcctagaagtattttgacttagtttactacgtgttacgagtcgaaggggtccgttaacggccctaacggttcgggtacccgttccgtttcggtttacccgggggacgggggtaaacgggggtaaaccccgttaaagggggtttcgggaaacgtaacgttaaacccggtaaaaacgggttaaccgttgggtacggggttaccttcgggaccctaaccgtactttccgttacggtttcccttacgtaacctttccccgtttaacccccgg

SEQ ID NO: 360598 - DNA, 597 bp, Homo sapiens
  misc_feature: GZ8MTXP01C6WDE.52.55.E11.1.454.CMB.2.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccacggagaagttgtattgacacagtctccagccacctgtctttgtctccgaggggganacgcccacctctcctgcagggccagtcagagtgtgcactntagctgaccaacaaactgcagctccagctcnatctatnatgcatccacggagggccacgtggcactcccagccgtaggttcaggtggcgtaggtgggtctggacgacaacgtacttcacctctacactatcgagtcgaccctagacgtcgtagtaacgttagtttacgactttagttttactacgtgtaccagtccgaagggtaccgttacgccctacgtcggtaccttccgtttcgggttaccggggcggggtaaacgggtaccgtaagggttgaaacgtaacgttacgaaaacgttagttgggtcgttacgttcgacctaactattcgtacgttcttctaacttcccgtaaccc

SEQ ID NO: 360599 - DNA, 712 bp, Homo sapiens
  misc_feature: GZ8MTXP01COI3G.52.55.E11.1.454.CMB.2.raw
  modified_base (202)..(202): a, c, t, g, unknown or other
  misc_feature (202)..(202): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctcgagggggganagcccaccctctcctgcagggccagtcagagttgttcggactaaccttcttagacctaggtaaacccaaacaaaaacccgtggacccaggccctacccgaggccctacctacatacctatgtatgaccactccgacgacggccaacgtcgactactcccgagccgtaggttccaggtggacgtaggtcgggtactggaacgactaacgtaacctttccgaacttccaacctaacctacgtacggtagttccgacccgttacgaccgtacgttagtaagtttagtttacgtactttaagtttacgttacttggtacagtaccgaggggtaccgtagtacctcggttcggtcttccgttcggtttaccggggacggtaacgggtaccgttaaaggtcgaacggtaaacttaaccgaaaacgggttccttaggtcggttacccgtttcggacccttaacgttaccttcgttacggtttaccccttccgttaacccgtttaaccccgttccccg

SEQ ID NO: 360600 - DNA, 578 bp, Homo sapiens
  misc_feature: GZ8MTXP01CDZ59.52.55.E11.1.454.CMB.2.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (397)..(397): a, c, t, g, unknown or other
  misc_feature (397)..(397): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgtgcactntagcctgacaacaaacngcagctccagctcncatctatgatgcactccacggacggccacgtggacactcccgagccaggttcagtggctaggtggtctagagacgaagtacttcactctacacatcgagtcgctcgacgctagaagtattttnacttagtttatacttgtacagcctagggcgttacgcctacgtgtccttcgttcgtttacgggcgggtaacgggtaccgttaagggtgtaacggtaacttaaccgaaaacggttaccgttggtacgggttaccttcggaccctaactacttcgttgtccttacttaaccttcccgttccccg

SEQ ID NO: 360601 - DNA, 627 bp, Homo sapiens
  misc_feature: GZ8MTXP01AUL5E.52.55.E11.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (612)..(612): a, c, t, g, unknown or other
  misc_feature (612)..(612): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganacgccaccctctcctgcagggccagtcagagtgttggctaacctcttagcctaggtaaccaaacaaacctggccaggctccagctcctnatctatgatgcactccgaggcggccacgtgacactcccgagcctaggttcaggtcggcgtagggtcgggtactaggaacgacgtaaacgtaccttcaacctcgtaccaacctatcgagttcgaccctcgacgtccgttagaacgttattttcgactttaagttttactagttcgtacagtcgagggtaccgtacgcctacgtgtcctcgttacggttcggggacggtaacgggaacgttaaggtcggaataacgttaaaccgaaaacggttcgtcgggttacgccgttacgaccgaaccttacgtcctttagctttaccncgtttcccctaaccg

SEQ ID NO: 360602 - DNA, 567 bp, Homo sapiens
  misc_feature: GZ8MTXP01B7O2L.52.55.E11.1.454.CMB.2.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
  modified_base (401)..(401): a, c, t, g, unknown or other
  misc_feature (401)..(401): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctntagcctaggtaaccaaacaaaactggccaggctccagctctacatctatgatgcatccacggaggccacgtggcactcccagccaggttcagtggcaggtgggtctgacgacaagtacttcactctacaccatcagtcgcctgagctgaagtntttgacttagtttatactgtacagcagggcgttaacgcccagtggccttctcggttacgggcggaagggtacctaagggttgaagtaacttacgaaaaacgttcgttgggtcggttaccttgacctaacccttagttccgttcttccttactccgttcccgtcccg

SEQ ID NO: 360603 - DNA, 632 bp, Homo sapiens
  misc_feature: GZ8MTXP01BP7LU.52.55.E11.1.454.CMB.2.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccaccctgttctttgtctccgaggggganacgccacctctcctgcagggccagtcagagtgttggctaactcttagcctaggtaaccaaacaaactggccaggctccaggctcncatctangatgcatccgacgacgggccacgtggaccactcccagccgtaggttcaggtcggcaggtcgggtctaggacgacgaagttaccgttccactcctacacctattcgaggttcgacccttgacgtccgtaaggtaacgttatttttacggactttaagttttacgttacgtcgttaccagtaccgtaggcgttaacgtccctacggtcgtccttccgtttcggtttaccggggacgggtacggggtaactaacggggttgaaagtaacttaccgaaaacggttaccgtgggtcgcgttggcctaactagtccttggtcctttcgaactttcccgtcccc

SEQ ID NO: 360604 - DNA, 622 bp, Homo sapiens
  misc_feature: GZ8MTXP01CF3SX.52.55.E11.1.454.CMB.2.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (366)..(366): a, c, t, g, unknown or other
  misc_feature (366)..(366): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagatgtgcactntagctgacaanaaacngcagcnccagctcnatcatgatgcatccacgaggccacgtggacatcccagccaggttcagtgcaggtcggtnganacaagtactcactctcacatcagtcgctcganctagaatatttgactagtttatacgtgtacacgtacagggtacgttagacctacggttggtccctttccgttcggttttaccgggggacggggttaacggggtaaacccgttaaaggggttccggggaaagtaacttaaaccgaaaaacggttaaaccgttaggggttcgggacctttcgggaacccctaacccgggtaaatttcccgggtttcgttcctttaccggttaaacctttcccccggttttaacccccg

SEQ ID NO: 360605 - DNA, 549 bp, Homo sapiens
  misc_feature: GZ8MTXP01BIYEQ.52.55.E11.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (345)..(345): a, c, t, g, unknown or other
  misc_feature (345)..(345): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgtgcaactnttagcctgtaaccaacaaaactgcagctccagctcctcatctatgatgcatccacgagggccagtggcatcccagccaggttcagtgcaggtggtctganacgaagacttcactctacaccatcgagtcgccctgacgcctagaagtatttgacttagtttactactgtcagtcaggcgtagcctacgtggtccttcgttcgtttacggggcggtaacgggacctaagggttgaagtacttacgaaaacgttctagggcgcgttcgactcctatccgttatctttacaactttccgtaaccccg

SEQ ID NO: 360606 - DNA, 628 bp, Homo sapiens
  misc_feature: GZ8MTXP01BEPUV.52.55.E11.1.454.CMB.2.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggancgcccaccctctcctgcgagggccagtcagagtgttggctaactnttagcctaggtaaccaaacaaaacctggaccaggcctcccaggcctcctcatctattgatcgcactccgacggagggcccacgtggcctacgtccccagccgtaggttcaggtcggctaggtcgggtctaggagaccgaagtacttcgactcctacacctatcagtcgcctgctctagattntttgacttagtttntcgtgtcagctacggtacgtacgaccctgtacgtccttcgtccggtttacggggaccgggtaaagggtacccgtaaagggttcgaacggtaacttaccggtaaaaccggttaagttcggtacgggaccttcggaccctaaacgtcttcgttacgttcccttactaacctttccggttaaccccg

SEQ ID NO: 360607 - DNA, 565 bp, Homo sapiens
  misc_feature: GZ8MTXP02I3VTK.52.55.E11.1.454.CMB.2.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
tcagcgcagtacgacacgaccggtgctcgatttagcactcgcacgttgggtttggggaggaactgctcagttaggaccagagggaaccatggaagcccagctcagcttctcttcctcctgctactctggctcccagataccaccggagaagttgtattgacacagtctccagccaccctgtcctttgtctccgaggggganagccacctctcctgcagggccagtcagagtgttggcaactnttagcctggtaccaacaaaacctggccaggcctccgagctccncatctatgatgcacnccacgacggccgacgtcggcactcccacgccgtacggttcgtacgtggcgacgtggtcgtgagacacgtactctactctcaccactcacgtcgcctcgtcgtcgtagagtaatttagttacttagtttacttactgtcgtacgacgtacgtacgtacgcgtacgtcgtcgtcgttcgttcggtacggtacggtacgtagtagtacgtacgtaacgtaaacgtacgtacgtcgtcgtacgactaacgtactctctctctctctccg

SEQ ID NO: 360608 - DNA, 626 bp, Homo sapiens
  misc_feature: GZ8MTXP02IY90M.52.55.E11.1.454.CMB.2.raw
  modified_base (202)..(202): a, c, t, g, unknown or other
  misc_feature (202)..(202): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccagggggganacgccaccctctcctgcagggccagtcagagtgttggacctaacctcttagcctaggtaacccaaacaaaaccgtggaccaggcctcccgaggcctcctcatctatgatgcactccgacggacggccacgtggaccactcccagcctaggttcaggtggacgaggtcgggtctagaacgacacgtacttcacttctaccaccatcgagtcgcctcgacgtcctagaaagttattttcgacttaagtttactacgtgtactagctaggtacgttacgcctacgttcggtccttcgtttccggtttcggggacgggtaacggggtaaccgtaaagggttcgaaacgtacgtaaaccgaaaacggtacgttcgggtacgactcgaccaaccgtacttcgtacgttaccttactacttcccgttcccg

SEQ ID NO: 360609 - DNA, 518 bp, Homo sapiens
  misc_feature: GZ8MTXP02IQ9U3.52.55.E11.1.454.CMB.2.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (282)..(283): a, c, t, g, unknown or other
  misc_feature (282)..(283): n is a, c, g, or t
  modified_base (285)..(286): a, c, t, g, unknown or other
  misc_feature (285)..(286): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagngtgtgctaactntagctgaaccaacaaacngcagcncngcncnatnanntnnancagnggcangcacnccagcagtcagtgcaggtggtngagacagtactcactcacacatcagtcgcctcgagcctagaagttatttgacttaagtttaactcgtagtacagacgacgacgtacgacctacgtcgtcgtcgttcgttcggtcgggacgggtacgtaaggtagtacgagtaacgaaacgaaacgtacgtcgtcgtcgacaacgactactctctctactctccg

SEQ ID NO: 360610 - DNA, 520 bp, Homo sapiens
  misc_feature: GZ8MTXP02JT7ZO.52.55.E11.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (269)..(270): a, c, t, g, unknown or other
  misc_feature (269)..(270): n is a, c, g, or t
  modified_base (272)..(278): a, c, t, g, unknown or other
  misc_feature (272)..(278): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (289)..(290): a, c, t, g, unknown or other
  misc_feature (289)..(290): n is a, c, g, or t
  modified_base (293)..(294): a, c, t, g, unknown or other
  misc_feature (293)..(294): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (304)..(305): a, c, t, g, unknown or other
  misc_feature (304)..(305): n is a, c, g, or t
  modified_base (309)..(310): a, c, t, g, unknown or other
  misc_feature (309)..(310): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgctccagggggganacgccacctctcctgcagggccagtcagagtgtgcactntagctgacaacaaacngcngcncngcncnntnnnnnnncagngcangcnnccnncngtnagngnngtgnnganananctcactctcacntcagtcgcctgacnctagaagtatttcgacttagtttattactgtactagacgagtacgtacgaccgtacgtcgtcgtcgttcgttcggtcgggacgggtaacgtaacggtaggtacgtacgtaacgaaacgtaaacgtacgtacggtacgtacgacgaacgtactactcgtcttactactaccgttcccg

SEQ ID NO: 360611 - DNA, 492 bp, Homo sapiens
  misc_feature: GZ8MTXP02GZD77.52.55.E11.1.454.CMB.2.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgtgcaactntagctgacaacaaactgcagctccagctctnatctatgatgcatccacgaggccacgtggcactcccagccaggttcagtggcagtggtctgagacagacttcactctcaccatcagtcggcctcgagctaggaatattttgctaagtttatactgtcagcagcgtagccagtgctctcgttggcgaggtaccaaggtnaagntagaaacgactgtcgacngacaacgtntctntctacncttcctcc

SEQ ID NO: 360612 - DNA, 501 bp, Homo sapiens
  misc_feature: GZ8MTXP02F4PJU.52.55.E11.1.454.CMB.2.raw
  modified_base (202)..(202): a, c, t, g, unknown or other
  misc_feature (202)..(202): n is a, c, g, or t
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgctccagggggganagccaccctctcctgcagggccagtcagagtgttggcaacctntagcctggtaccaacaaaactggccaggctccagctcctcatctatgatgcatccacgaggccactggcatcccagccaggttcagtggcagtggtctgatacagacttcactctcaccatcagtgcctcgancctgaacgtatttgctagtttatactgtcagcagcgtagccatggctcgtcttcggcgaggacctaagggttnagatacgaaaacgtactgtacggctgcaacatctgtcttcactcttcccg

SEQ ID NO: 360613 - DNA, 542 bp, Homo sapiens
  misc_feature: GZ8MTXP02GF9ZT.52.55.E11.1.454.CMB.2.raw
  modified_base (204)..(204): a, c, t, g, unknown or other
  misc_feature (204)..(204): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctctagcctggtaccaacaaaacctggaccaggctcccaggctcctcatctatgatgcatccacggaggccactggcactcccagccaggtcagtggcaggtgggtctggagacagacttcactctcaccatcagtcgcctgacgcctagaacgtattttgactagtttatactagtcagcagcgtacgccagtcgtcctcgttcgttcgggcggaggaccgtagggttgaaggtactacgaaaacgtacgtggtacgtcncgactaacgtnttcgtctacttctaccttccgtccg

SEQ ID NO: 360614 - DNA, 496 bp, Homo sapiens
  misc_feature: GZ8MTXP02FZOFA.52.55.E11.1.454.CMB.2.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (333)..(333): a, c, t, g, unknown or other
  misc_feature (333)..(333): n is a, c, g, or t
  modified_base (417)..(417): a, c, t, g, unknown or other
  misc_feature (417)..(417): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgtgcaactntagcctgtacaanaaacngcagctccagctcncatctatgatgcatccacgaggccactggcatcccagccaggttcagtgcagtgggtcngagcagacttcactctcaccatcagtcggcctcgagcctgaagtattttgctagtttatctgtcagcagcgtagccactgcctntcgtttcggcggtaggactaggttgacgactacgaaacgactgtcgactgccaacgtatctcgtcttacacttctcccg

SEQ ID NO: 360615 - DNA, 691 bp, Homo sapiens
  misc_feature: GZ8MTXP02GTZQY.52.55.E11.1.454.CMB.2.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctnttagcctggtaaccaaacaaaacctggaccaggctcccaggctcctcatctatgatgcatccacggacggccacgtggcactcccagcctaggttcaggtggctaggtggggtctaggacgacgtacgaccttcaccttctaccaacctagttacgacggttcgggacccttacgggacgtcccgttaggtaaagttgtttttacggacctttaaggtttttaacttacgttcgttacgaacggtctaagggtccgttaacgcccgtacgttcggggtccctttccggtttccgggtttacgggggaccgggttaaacgggggtaacccgttaaaaggggttcgaaaggtacttaaacgaaaaccggtaacgttgggtacggaccttacgaccctaaaccgtactttcgttacgttcctttacgtaccgtttcccttaccccg

SEQ ID NO: 360616 - DNA, 571 bp, Homo sapiens
  misc_feature: GZ8MTXP02INIJ5.52.55.E11.1.454.CMB.2.raw
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacccttttctttgtctccgagggggagagccaccctctcctgcagggccagtcagagtgttggcaacctnttagcctggtaccaacaaaacctgccaggctccagctcctcatctatgatgcatccagacgggccacgtggcatcccagccaggttcagtggcaggtcgggtctgagacagacttcnctctcaccntcagtcgcctcgacncctagaagtattttgcttagtttacttacgtgtcagtcagtcgtacgcctacgtcgggccttcgttcgtttacgggcgggtagggacccgtaagggttcgaagtactacgtaaaacgaacgttggtacggtcgtacgaccaccgtaacttcgtcgttccttactacttcccgtttacccgtcc

SEQ ID NO: 360617 - DNA, 572 bp, Homo sapiens
  misc_feature: GZ8MTXP02FNYRX.52.55.E11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaacctntagcctggtaccaacaaactgcagctccagctcncatctangatgcatccacggacggccacgtggcactcccagcctaggttcaggtggcaggtcgggtctgagacagacttcactctcaccatcagtcgcctcgagtcctagaagtnttttcgacttagtttacttacgtgtcaagcagtcgtagcctagtcggtccttcgttccgtttcggggacgggaagggtaccgtaagggttcgaagtactaacgaaaacgtacgtggtacgtaccgtgaaccaaccgtacttcgttacgttcctttacgtaccttcccgttaccccg

SEQ ID NO: 360618 - DNA, 524 bp, Homo sapiens
  misc_feature: GZ8MTXP02JXUCY.52.55.E11.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
  modified_base (383)..(383): a, c, t, g, unknown or other
  misc_feature (383)..(383): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagccaccctctcctgcagggccagtcagagtgttggcaacctnttagcctggtaccaacaaaacctggccaggctcccaggctcctcatctatgatgcatccacgaggccatggcatcccagccaggtcagtggcagtggtctgagacagacttcactctcaccatcagtcggccctgancctgaagtatttgctagtttatactgtcagcagcgtagccacgtgctcgtcgttcgggcggtagggacctaaggttcgaaggactacgaaacgtaactggtacggctggccaacgactctacgtcttcacttcgtttcccg

SEQ ID NO: 360619 - DNA, 548 bp, Homo sapiens
  misc_feature: GZ8MTXP02IB7O9.52.55.E11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtcctttgtctccagggggganagcccaccctctcctgcagggccagtcagagtgttggcaactnttagctgtaccaanaaacctgcagcnccagcnctnatctatgatgcatccacggaggcccaagtggcactcccagccaggtcagtggcagtgggtctgagacagactttcactctcacctatcgagtcgccctgancctgaaagtnttttgcttagtttatactgtcagctagcgttagccagtgctcttcgtttcgggcggtacgggacctaagggttcgaagtagttacgaaaacgtaacgtggttacgacttgacctaacccgtatcttcggtacctttcctaacgtttccctccccg

SEQ ID NO: 360620 - DNA, 569 bp, Homo sapiens
  misc_feature: GZ8MTXP02FNAUM.52.55.E11.1.454.CMB.2.raw
  modified_base (246)..(246): a, c, t, g, unknown or other
  misc_feature (246)..(246): n is a, c, g, or t
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggggaagcccaccctctcctgcagggccagtcagagtgttggcaactnttagcctggtaccaacaaaactggccaggctcccaggctccncatctatgatgcatccacggaggccacgtggcatccccagccaggttcaggtggcaggtgggtctgagacagacttcactctcaccatcagtcgcctganctagaatntttgntagtttatactgtcagcagcgtagcctagtcggcttcgtcgtttcggggacggtacgggtaccgtaagggttcgaaggtattaaccgaaaacggtaccttggacggtaccttggaaccaaccgtacgttccttaggttccctttactaacctttcccgtttacccccg

SEQ ID NO: 360621 - DNA, 568 bp, Homo sapiens
  misc_feature: GZ8MTXP02IBRQ4.52.55.E11.1.454.CMB.2.raw
  modified_base (205)..(205): a, c, t, g, unknown or other
  misc_feature (205)..(205): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (385)..(385): a, c, t, g, unknown or other
  misc_feature (385)..(385): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtcctttgtctccgagggggganagcccaccctctcctgcagggccagtcagagtgttgcaactnttagctgaccaaacaaactgcagcnccagcncnatctatgatgcatccagnggccatgcatcccagccagtcagtggcagtggtcngagacagaccttcacttctcaccatccgagtcgccctgagcctgaaacgttnttttgacttagtttacttacgtgtacagtctaggtcgtacgcctacgtcgtacctcgtttccggttcggggacgggtaacgggaccgtaaaggggttacgaacggtacgtaacgaaaacgtagtacggtcggtacgtacgacctaacgtacttcgttcgttaccttactactttccctacccg

SEQ ID NO: 360622 - DNA, 591 bp, Homo sapiens
  misc_feature: GZ8MTXP02F1HOD.52.55.E11.1.454.CMB.2.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccacggagaagttgtattgacacagtctccagccaccctgtctttgctccgagggggganagcccaccctctcctgcagggccagtcagagtgtgcaactntagctgacaanaaacngcagcnccngctcnatcangatgcatccagnggccatggcatcccagcctagtcagtgcagtggtctgagacagacttcactctacaccatcagtcgcctgacgctagaaagttntttgacttaagtttatacgtgtacagtccaaggtcgtaacgccctaacgtcggtccttcgttccggtttcggggaccgggtaacggggtaacccgtaaagggttcggaaacgtacgttaaaccgaaaacggtaacgttcgggttacggaccgtcggaaccctaaacccgttacgttaccgttacgttacctttaccgtacctttccccgttaccccg

SEQ ID NO: 360623 - DNA, 529 bp, Homo sapiens
  misc_feature: GZ8MTXP02JLHAV.52.55.E11.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (279)..(280): a, c, t, g, unknown or other
  misc_feature (279)..(280): n is a, c, g, or t
  modified_base (283)..(284): a, c, t, g, unknown or other
  misc_feature (283)..(284): n is a, c, g, or t
  modified_base (286)..(286): a, c, t, g, unknown or other
  misc_feature (286)..(286): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagagtgtgcactntagctgacaanaaactgcngcncngcncnntnannatnnancagagccatgcactccagccaggtcagtgcagtggtctgagacagacttcgactctcacatcagtcgcctcgacgtccgtagaagtatttgacttagtttatactgtactagcagcgtagctagtcgcttcgttcggttcgggcggtaacgggtacctaagggttcgaacggtactaacggaaaacgtacgtggtacgtacgtcgaccaactacgttcttcgttacttctacgtccttccccg

SEQ ID NO: 360624 - DNA, 542 bp, Homo sapiens
  misc_feature: GZ8MTXP02F7E8K.52.55.E11.1.454.CMB.2.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagcccaccctctcctgcagggccagtcagagtgttggcaacctnttagcctggtaaccaacaaaacctggccaggctcccaggctcctcatctatgatgcatccacgaggccactggcatcccagccaggttcagtggcagtgggtctgagacagacttcactctcacctatcagtcgcctgagcctagaagtatttgctagtttatactgtcagcagcgtagccagtgcttcgtcgtttcgggcggtagggacctaagggttcgaaggtataccgaaaacggtacgtggtcggctcggacaaccgtattcctggttccttcacttcccgtttaccccg

SEQ ID NO: 360625 - DNA, 547 bp, Homo sapiens
  misc_feature: GZ8MTXP02HQ1P3.52.55.E11.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
  modified_base (470)..(470): a, c, t, g, unknown or other
  misc_feature (470)..(470): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtcctttgtctccagggggganagccaccctctcctgcagggccagtcagagtgttgcaactntagcctgacaacaaacngcagcnccagcncnatctatgatgcatccacgaggccacgtgcactcccagccaggttcagtcggcaggtcgggtctgacgacagtacttcacttcacacctatcagtcgacctgagctagaagtnttttgacttagtttatacgtgtcaagccagtcgttagccctagtcgcttcgttcgttcgggcgggtaaggcctaaagggttnaacgtactaaacgaaacgtagtcgtacgacctagacctaaccgtattcgtcgttccttacgtacctttcccgtaccg

SEQ ID NO: 360626 - DNA, 568 bp, Homo sapiens
  misc_feature: GZ8MTXP02GB74H.52.55.E11.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagngtgttggcaactnttagcctggtaccaacaaaactggccaggcncccaggctccnatctatgatgcatccacggacggccacgtggcactcccagcctaggttcaggtcggcaggtgggtctgagacagtacttcactctcaccatcagtgccctgacnctagaacgtnttttgcttaagttttactactgtcaggtcaggtcgtacgcctagtcgcttcgttcgttcgggacggtacggaccgtaagggttcgaacgtagttaccgaaaaacggtcgtggttacgggcctggaccaaccgtattcgtcgttccttacgactttcccgtacccg

SEQ ID NO: 360627 - DNA, 526 bp, Homo sapiens
  misc_feature: GZ8MTXP02FW1D7.52.55.E11.1.454.CMB.2.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccaggggganagccaccctctcctgcagggccagtcagagtgttggcaacctnttagcctggtaccaacaaaacctggccaggctcccaggctcctcatctatgatgcatccacgagggccactggcatcccagccaggttcagtggcagtgggtctgagacagacttcactctcaccatcagtcgcctgancctagaagtatttgctagtttattacngtcagcagctagccactgctcgtcgttcgggcggtagggaccaaggttcgaagtactacgaaaacgtacgttgtacgctcgaccaaccgtatctcgtctttacacttccttccccg

SEQ ID NO: 360628 - DNA, 535 bp, Homo sapiens
  misc_feature: GZ8MTXP02HO16F.52.55.E11.1.454.CMB.2.raw
  modified_base (205)..(205): a, c, t, g, unknown or other
  misc_feature (205)..(205): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtcctttgtctccgagggggganagccaccctctcctgcagggccagtcagagtgttggcaacctcttagcctggtaccaaacaaaacctggaccaggctcccagctcctcatctatgatgcatccacggaggccagtggccatcccagccaggttcagtggcaggtggctgagacagactcactctacacctatcagtcggacctcgagcctgaagtnttttgcttagtttatactgtcagctagcggtacnctagtcgtctcgtcgttcgggcggtacggacgtagtgacgactaacgaaacgtacgtgtacgctcgacctaacgtctcgttctcttactactttcctccg

SEQ ID NO: 360629 - DNA, 577 bp, Homo sapiens
  misc_feature: GZ8MTXP02HOBOI.52.55.E11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagccaccctctcctgcagggccagtcagagtgttggcaactnttagcctgtaccaacaaaactgcagctccagcnctcatctatgatgcatccacgaggccactggcatcccagccaggttcagtgcagtggtctgagacagactcactctcaccatcagtcggcctcgacgcctagaaagtagtttttgacttagttttacttacgtgtacagtcaaggtcgttagcctacgtggccttcgttcgtttaccggggcgggttaacgggaccgtaaagggttcgaacggtactaacgaaaacgtaaacgttcggtacggccttacggactaaccgtacgttcgttacgtcctttacaccgtttccgttacccccg

SEQ ID NO: 360630 - DNA, 561 bp, Homo sapiens
  misc_feature: GZ8MTXP02GV3Z2.52.55.E11.1.454.CMB.2.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (427)..(427): a, c, t, g, unknown or other
  misc_feature (427)..(427): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgctccgagggggganagcccaccctctcctgcagggccagtcagagtgttggcaacctctagcctgaccaacaaactgcagcnccagctcncatctatgatgcatccacgaggccacgtggcactcccagccgtaggttcaggtggcgtaggtcgggtctagagacagtacttcactctcaccatcgagtcgcctcgagctagaagtatttgcttagtttatactgcagcagtcgtacnccgacttggtccttcgttccgttcggggacgggtaacgggaaccgtaagggttagaacgtaacgttacgaaaacgggtaactggtacggtacctgaccgtaactactcgttcttccttacacttcccttacccg

SEQ ID NO: 360631 - DNA, 504 bp, Homo sapiens
  misc_feature: GZ8MTXP02G85LJ.52.55.E11.1.454.CMB.2.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
  modified_base (410)..(410): a, c, t, g, unknown or other
  misc_feature (410)..(410): n is a, c, g, or t
  modified_base (447)..(447): a, c, t, g, unknown or other
  misc_feature (447)..(447): n is a, c, g, or t
  modified_base (481)..(481): a, c, t, g, unknown or other
  misc_feature (481)..(481): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccacctgtctttgtctccaggggganagccaccctctcctgcagggccagtcagagtgtggcaactntagcctgtaccaacaaactgcagctccagctcncatctatgatgcatccacgaggccatggcactcccagccaggttcagtggcaggtgggtcngagacagacttcactctcaccatcagtcggctgagcctgaatattttgctaagtttatactgtctagcagcgtancctatggcttctcgtttcggcgacgggtacaaggttnaacggatacgaaacgtaagtgtcgactgacaacngtctgtactctactccgttaccc

SEQ ID NO: 360632 - DNA, 636 bp, Homo sapiens
  misc_feature: GZ8MTXP02IZ0G5.52.55.E11.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (409)..(409): a, c, t, g, unknown or other
  misc_feature (409)..(409): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttgcaactntagcctgaccaacaaacngcagcncagctcnatctatgatgcatccacgaggcccacgtggcactccccagcccgaggttcaggtggcaggtggtctgacgacacgtaccttcacctcctccacctatcgaggttcggccctggacgtccgtaaggtaacgttnttttacggactttaagtttttacttaccgtgtactaaggtccgtaaggtccgttaacgacccctagttccggtccttcgttcggtttccggggacggggtaacgggtaaccgtaaggggttcgaacggtacgttaaaccgaaaacggtacgtgggtaccgggtacttacggaccctaaccgtcttaccgttcgttaccctttacctaccgtttccccgtttaccccg

SEQ ID NO: 360633 - DNA, 548 bp, Homo sapiens
  misc_feature: GZ8MTXP02I8UIX.52.55.E11.1.454.CMB.2.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (278)..(279): a, c, t, g, unknown or other
  misc_feature (278)..(279): n is a, c, g, or t
  modified_base (283)..(285): a, c, t, g, unknown or other
  misc_feature (283)..(285): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttgcactntagctgacaanaaactgcagcnccagctcnatcnngatnnntcagnggcangcancccngccaggtcagtgcagtggctgancagctcactcncacntcagtcgctcgagtcagattntttgacttagtttatcgtgtacgagcgtagacgtacgccctacgttcggaccttcgtacggtttccgggggacgggtacgggtaaccgtaagggttgaacgtaacgtaacgaaaacggtacgttaggtcggacttacggaacctaaccggtattccgttcgtacttaccgtactttcccgtacccg

SEQ ID NO: 360634 - DNA, 562 bp, Homo sapiens
  misc_feature: GZ8MTXP02GGG9P.52.55.E11.1.454.CMB.2.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (287)..(287): a, c, t, g, unknown or other
  misc_feature (287)..(287): n is a, c, g, or t
  modified_base (404)..(404): a, c, t, g, unknown or other
  misc_feature (404)..(404): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgctccagggggganagccacctctcctgcagggccagtcagagtgttggcaacctnttagcctggtaaccaacaaaacctggccaggctcccaggctccncatctatgatgcatccacgcggccagtggcactcccagcctaggttcagtcggcaggtgggtctgacgacagtacttcactctacaccatcagtcgcctcgacgtcctagaacgttnttttcgacttaagttttatactgtcagctagcgtagccagtcgccttcgttcgtttcgggacgggtaggtaaccgtaagggttcgaagtactaacgaaaacggtactgggtcgtactcgaccaaccgtacttcttacgttcttcacttcccttacccg

SEQ ID NO: 360635 - DNA, 567 bp, Homo sapiens
  misc_feature: GZ8MTXP02FGWK2.52.55.E11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (278)..(279): a, c, t, g, unknown or other
  misc_feature (278)..(279): n is a, c, g, or t
  modified_base (283)..(288): a, c, t, g, unknown or other
  misc_feature (283)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (295)..(296): a, c, t, g, unknown or other
  misc_feature (295)..(296): n is a, c, g, or t
  modified_base (299)..(300): a, c, t, g, unknown or other
  misc_feature (299)..(300): n is a, c, g, or t
  modified_base (303)..(304): a, c, t, g, unknown or other
  misc_feature (303)..(304): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
tcagcgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgtggcaacctntagcctggtaccaacaaacngcngcnccggncnntcannnnnncngngcnngcnnccnnccagttcngngcagtcggctgagcagacttcnctcncaccatcagtgcctcgagccctgaacgtatttgctaagtttattacgtgtaccaagcagcgtacgcccacgttgggcctttccgttcgtttccggggacgggtaacggggaaccctaaaggggtttgaacgtactaaccgaaaacgtaaaccgtggtacggaccttggaccctaacccgtaacgttcttacggttcccttacgtaacttccccgtttcccccggaac

SEQ ID NO: 360636 - DNA, 570 bp, Homo sapiens
  misc_feature: GZ8MTXP02H9QQ0.52.55.E11.1.454.CMB.2.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccaccctgtctttgtctccgagggggganagcccaccctctcctgcagggccagtcagagtgttggcaacctnttagctggaccaaacaaactgccagcnccagctctcntctatgatgcatccgacgacgggccaacgtggaccactcccgagccaggttccaggtggctaggtgggtctgagacagtactttcaacttctccaacctatccgagttcgccccgtagagtccctaggaagtagtttttgacttaagtttattactgttcaagtccaagtcgtagcctacgtggtctccgttcgtttcgggcgggtaggtaccgtagggtcacggatacgaaacgtagttcgtacggactcgctaaccgtatcgtgtcctactactttccctcccg

SEQ ID NO: 360637 - DNA, 631 bp, Homo sapiens
  misc_feature: GZ8MTXP02HIEVQ.52.55.E11.1.454.CMB.2.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctccagataccaccggagaagttgtattgacacagtctccagccacctgtctttgtctccgagggggganacgcccaccctctcctgcagggccagtcagagtgttggcaactntagctgtaccaanaaactgcagcnccagctcncatctatgatgcactccgaacggacggcccaacgtggaccacgtccccgacgccgtaacgggttccaaggtcgggacaggggttggggtacctaggaacgacgaacgtaactttccaaccttctaccaacctaagttcgaagttccgggcccttcggaacgtcccgtaagtaagtattttcggacttagttttactactgtacagctaaggcgtacgcctagttcggtcttcgtccggtttcgggacgggtaacgggtacgtaaagggttacgaaacggtacttaaacgaaaacggacgttgacggtctagacccaacctgtaccgttcgtactttacctactttccgtaccc

SEQ ID NO: 360638 - DNA, 589 bp, Homo sapiens
  misc_feature: GZ8MTXP02FMULR.52.55.E11.1.454.CMB.2.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (279)..(281): a, c, t, g, unknown or other
  misc_feature (279)..(281): n is a, c, g, or t
  modified_base (283)..(288): a, c, t, g, unknown or other
  misc_feature (283)..(288): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (322)..(323): a, c, t, g, unknown or other
  misc_feature (322)..(323): n is a, c, g, or t
  modified_base (346)..(346): a, c, t, g, unknown or other
  misc_feature (346)..(346): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagngtgttgctaactntagctgaccaacaaacngcagcnccngctcnnnannnnnncagngcagngcncnccngcagtcngtgcaggtgnngagacagtacttcactctcaccntcgagtcggcctgacgtcctagtaacgttgttttacgactttaagttttactacgttcgttacagtccgtaacggtcgtacgcccgtacgttcggtcccttccggtttccgggttcggggaccgggtaacggggtaccgtaaaggggttgaaacggtaacgtaaaccggaaaacggtcgttgggtacggtactacgaccctaacgtacgttctcgtttccttactaccgtttcccttaccccg

SEQ ID NO: 360639 - DNA, 558 bp, Homo sapiens
  misc_feature: GZ8MTXP02HOO65.52.55.E11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (442)..(442): a, c, t, g, unknown or other
  misc_feature (442)..(442): n is a, c, g, or t
  modified_base (529)..(529): a, c, t, g, unknown or other
  misc_feature (529)..(529): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgttgcaacctnttagcctggtaccaaacaaaacctggccaggctcccaggctcctcatctatgatgcatccgacgacggcccaacgtggccactcccagcctaggtcgaggtggcaggtgggtctgaganacgtacttcactctacacctatcgagtcgcctgcgtctagattgtttgactttagtttactgtgtcagctagcgttanccgacgtcgcttcgtcggttacgggcggtaacggaccgtaggttcgaacgtacgtacgaaacgtacgtggagtcgtgacctaacgtntctacgttctacgtacctttccctacccg

SEQ ID NO: 360640 - DNA, 609 bp, Homo sapiens
  misc_feature: GZ8MTXP02I9LHA.52.55.E11.1.454.CMB.2.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgctccgaggggganacgccacctctcctgcagggccagtcagagtgttgcactntagctgacaanaaactgcagcnccngcncnatcangatgcatcacgacggccagtggcactcccgagcctaggttccagtcggcaggttgggtctaggacgacagtacttcactctacaccctagtcaaggtcggccctcgacgtccgtaagtaacgtacgtttttgacgttaagtttttaacttacgtagttcaaacgtcgtaaacggtcggttaaacgcccctaagttcggtctttccgttccggtttcgggacgggtaacgggaaccgtaaggggttcgaagtacgttaaacgaaaacggtaacgttggtacggtcctagaccaacctagtaccgttcgttaccttactaccttccgttaccccg

SEQ ID NO: 360641 - DNA, 566 bp, Homo sapiens
  misc_feature: GZ8MTXP02G4U7F.52.55.E11.1.454.CMB.2.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (406)..(406): a, c, t, g, unknown or other
  misc_feature (406)..(406): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgctccgagggggganagccaccctctcctgcagggccagtcagngtgtgcactntagctgacaanaaacngcagctccagctctnatcatgatgcatccgacgacggccacgtgcactcccagccgaggttccaggtggacacggtggggtctgacggaccagtaccttcacttctaccaaccatccaggtccgacctcgacgcctaggaaacgtttntttagactttagtttattacgtgtacgagtacgagtacgtacgcctagtcgtcttcgttcggttcgggacgggtaacggtacgtagtcgaacgtactacgaaacgtagtcggtacgtacgtgaccgtaactcgttcgtcgttactctaccgttccgtccg

SEQ ID NO: 360642 - DNA, 585 bp, Homo sapiens
  misc_feature: GZ8MTXP02F8WQD.52.55.E11.1.454.CMB.2.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccacctctctgcagggccagtcagagtgtggcaactntagcctggaccaacaaactgcngctccagctctcatctatgatgcatccacggacggccactgacactacccagccctaggttcaggtcggcaggtgggtctaggagtacagtacttcacttcncaccntacgagtccgcctcgagtcctagaattagtttgactttagtttaatacgttagtcagcgagcgtagccgtacgtggtaccttcgttcggttacgggacgggtacgggtaaccgtaaggggttacgaacgtaacgtaacgtaaaacggtacgtcggttacggacctagacctaacgtacttcgttacggttcttacgtacttcccgttaccccg

SEQ ID NO: 360643 - DNA, 679 bp, Homo sapiens
  misc_feature: GZ8MTXP02H68GT.52.55.E11.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgtctccgaggggganagccaccctctcctgcagggccagtcagngtgttgcactnttagctgaccaaanaaactgccaggctccagctctnatcatgatgcatccagacggccacgtggcactcccagccgaggttcacggtggctaggtggtctaggacgacaggtacttcaccttcgtaccaacctattccgaaaggttcggacccttacggacgtcccgtaggtaaacggttacgtttttacggacctttaaagtttttaacgttaaccgttcgtacgtacggtacgtaacggtacggttaaacgtccccgtaacggttccgggtacccttcggttacccggttttacggggaacgggttaaccgggtaaccgtaaaggggtttacgaacggtaacgttaaaccgaaaacggtacgttacgggtacggtaccgttacgacctaacgtacgttacgtacgttaccttaccgtactttacccgttcccccg

SEQ ID NO: 360644 - DNA, 602 bp, Homo sapiens
  misc_feature: GZ8MTXP02JAKKS.52.55.E11.1.454.CMB.2.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
  modified_base (402)..(402): a, c, t, g, unknown or other
  misc_feature (402)..(402): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaacctnttagcctggtaccaacaaaacctgccaggctccaggctcctcatctatgatgcatccacggacggccactggcacgtccccagccaggttcagtggcaggtggtctgacgacagacttcactctcaccatcagtcgcctcgacgcctagaagtnttttagaccttaaggttttataacgttgtaccgagtaccgaacggtcgtacgccctagtccggtaccttcgttcgtttacggggcggaaggggtacccaagggttacgaagtacgtaacaaaacggttaactcgggtacggtactaccggactaacctagttacccttggttaccttccgtactttcccgtttacccccg

SEQ ID NO: 360645 - DNA, 606 bp, Homo sapiens
  misc_feature: GZ8MTXP02FT9H1.52.55.E11.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (376)..(376): a, c, t, g, unknown or other
  misc_feature (376)..(376): n is a, c, g, or t
  modified_base (416)..(416): a, c, t, g, unknown or other
  misc_feature (416)..(416): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgctccgaggggganacgccacctctcctgcagggccagtcagagtgtgcactntagctgtaccaacaaacngcagctccagctcnatctatgatgcactccgacggtacggccacgtggccactccccagcccgtaggttccaggtcggcgtaggttcggggtccaggacgacacgtaccttcacttcnccaacctatccgagtcgcctcgacgtctaggaaacgtttntttcgactttaagtttacttacgtagtacgtacgacgtaggccgtacgcctacgtcgtcttcgttacggtcggggacggtaacggtaccgtaagggttacgaacgtaacgtaaacgtaaacggtgtacggtcggactacgtaactaaccgttacgttcgttacgttccttacctacttccccgtttaccg

SEQ ID NO: 360646 - DNA, 755 bp, Homo sapiens
  misc_feature: GZ8MTXP02HGDAP.52.55.E11.1.454.CMB.2.raw
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccacctgtctttgctcgaggggganagccaccctctcctgcagggccagtcagtagtgttggcaactnttagcctggtaaccaaacaaaaccgtgccaggcctccaggcctcctcatctatgatgcatccgacggacgggccacgtggccacgtccccgaacggccgtagggtttccaaggttcggcgtagggttggggtcctaggacgactacggtaacctttccaccttcctaccaaccctattccgaagggttcccggacccgtttaacggccgtacccgttaagggtaaacgtttacgtttttggtacctttaaaggtttttacctttaaacgttcgggttaccttaaagggccgttaaacggtccggttacgtaccccgtacgggttcgttcccgtttccggttaccgggttttacgggggcccggggttaacggggttaacccgtaaaaggggttcgaaacggtaaaacgtaaccggtaaaaacgtcgtttaacggggtcgaccggttacgaacccttaacgtaacgtttcttaacggttaccctttcggttaaccctttccccctttacccgg

SEQ ID NO: 360647 - DNA, 697 bp, Homo sapiens
  misc_feature: GZ8MTXP02IRA6O.52.55.E11.1.454.CMB.2.raw
  modified_base (204)..(204): a, c, t, g, unknown or other
  misc_feature (204)..(204): n is a, c, g, or t
  modified_base (426)..(426): a, c, t, g, unknown or other
  misc_feature (426)..(426): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgttctttgtctccgaggggganacgccaccctctcctgcgagggccagtcagagttgttgactaactcttacgcctaggtaaccaaacaaacctggaccaggcctccaggcctcctcatctatgatgcactccgaacggacggcccaacgtggaccaccgtcccgacgccgtaggttccgaggtcggcgtaggtcgggtactggaacgacgtaacgttccttcgtaccttcctacccaaccgtntaccggtagggttcccggaccccgttacgggaccgtacccgttaaaggtaacgttttaacgtttttacggtacgttttaacgtttttacgttaaccgtacgtacgtacgtaccgtaagggtaccgttaacgccctaggtcccgtctttaccggttcgtttacggggacggttaaccggtaacgttaggtacggaatacgttaaacgaacgtacggttgaccgtactacgacctaacgtacttcgtacgttctacctaccgttccctacccg

SEQ ID NO: 360648 - DNA, 611 bp, Homo sapiens
  misc_feature: GZ8MTXP02FIT2D.52.55.E11.1.454.CMB.2.raw
  modified_base (206)..(206): a, c, t, g, unknown or other
  misc_feature (206)..(206): n is a, c, g, or t
  modified_base (406)..(406): a, c, t, g, unknown or other
  misc_feature (406)..(406): n is a, c, g, or t
tcagcgcagtacgacacgaccggtgctcgatttagcactcgcacgttgggtttgggggaggaactgctcagttaggacccagagggaaccatggaagccccagctcagcttctcttcctcctgctactctggctcccagatacccaccggagaagttgtattgacacagtctccagccaccctgtctttgcctccgaggggggganagcccaccctctcctgcagggcccagtcagagtgttggctaacctcttagcctggtaacccaaacaaaaacctcggaccaggcctcccgaggcctcctcatctatgatgcactccgacggacggtccacgtggcactcccagccgtaggttcaggtcggcgtaggtcggggtctaggacgacagtacttcactctcaccntcgagtcggcctcgacgtcgtagaagttattttgacgttaagttttattacctgtacgtacgcgtacggtccgtaacgccctaacggtcggtccttcgttcggtttcgggacggtaacggaccgtaggtgaacgtataacgaaaacgtactgggtacgctcgaccgaacctagtccgttactcgttacctacgttccctaccccg

SEQ ID NO: 360649 - DNA, 632 bp, Homo sapiens
  misc_feature: GZ8MTXP02JFQM2.52.55.E11.1.454.CMB.2.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (589)..(589): a, c, t, g, unknown or other
  misc_feature (589)..(589): n is a, c, g, or t
  modified_base (616)..(616): a, c, t, g, unknown or other
  misc_feature (616)..(616): n is a, c, g, or t
tcagcgcagtacgacacgaccggtgctcgatttagcactcgcacgttggggtttggggggaggaactgctcagttaggacccagagggaaccatggaagccccagctcagcttctcttcctcctgctactctggctcccagataccaccggagaagttgtattgacacagtctccagccaccctgtctttgtctccgaggggggagagccaccctctcctgcngggccagtcagagtgttggctaactctacgctaggtaccaaacaaactggaccagcctccgngctcctnctatatnatcgactactaccgacggacggccaactggcactccccagcctacggttcagggtgcgtacgggttgggtcgtagaacgtacgacacttccactacctccgaaacctagtacgtaggtccggttcccgcgtacggtacctaggtaacgtttaagttttcgacgtttaaggtttactacgttacgttcgaagccgtaaggtcccgtacgtacgtacgttcggtccttcggttcggttccggggacgggtaacgggtacgtaagggttcgaaagtcgaaacgaaaaccggtntcgtacgctgacctaacgtatccgttnttactctcgttctccc

SEQ ID NO: 360650 - DNA, 564 bp, Homo sapiens
  misc_feature: GZ8MTXP01ARIR2.44.42.D09.1.454.CMB.2.raw
  modified_base (422)..(422): a, c, t, g, unknown or other
  misc_feature (422)..(422): n is a, c, g, or t
tcagacagtatatacacgaccggtgctcgatttagacacatacgcagggaaagggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggacaaacgcccccaaactcatacttttgagtccagtgagcggccgtcaggtgtttctaatcgcttctctggctccaagtctggccacacggcctccctgtcgatctctcgggctccggacctggacggacgaggctgactattacgngcggcttcgatttaccacttcttagagtaccgttggggtcgtttcgggcggtaggggttcctcgacccgtggtaacccgttccgttacgggttcccaacggccccgaaggtccctcggccccccgtcgggttccctaacccg

SEQ ID NO: 360651 - DNA, 571 bp, Homo sapiens
  misc_feature: GZ8MTXP01CUYEF.44.42.D09.1.454.CMB.2.raw
  modified_base (328)..(328): a, c, t, g, unknown or other
  misc_feature (328)..(328): n is a, c, g, or t
tcagacagtatatacacgaccggtgctcgatttagacacatacgcagggaaagggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcatcacatctctgcacgtgggtccagcaatgacagttgggagatataaccttgtctcctggtatcaacaacatccaggacaaacgacccccaaactcattacttttgagtccagtgagcggcgtcaggtntttctaactcgtcttctctggctccaagtctggcccacaccggcctccctgtccgatctcgtgggcctccggctgaggacgaggctgactattacgtcggcggtctctactttacacgttcttagtagtacgtttggggtcgttcgggcgggtagggggttacctccgaccgttacgcccgttccgttgggttccaacgtccccgaaggtcccgtaccgcccccgtaacggttcctaaccccg

SEQ ID NO: 360652 - DNA, 643 bp, Homo sapiens
  misc_feature: GZ8MTXP01B2TOQ.44.42.D09.1.454.CMB.2.raw
  modified_base (183)..(183): a, c, t, g, unknown or other
  misc_feature (183)..(183): n is a, c, g, or t
tcagacagtatatacacgaccggtgctcgatttagacacatacgcaggggggggtcacaagaggcagcgctctcgggacgtctccaccatggcctgggctctgctgctcctcactctcctcactcaggacacagggtcctgggcccagtctgccctgactcagcctgcctcgtgtctggttcncctggacagtcgatcacatctcctgcactggtccagcaatgacagttgggatatataacttgtctctgatacaacacatccaggaccaaacgcccccaaatctaatttacttttgacgtaccagtgagcggtccgtgtaggttgttctaatcccgtctttcgtcgtgccttaaccgaagtctcggacccacgaccggtcctcctgtcgactcgtcgtcgggcctccggctagggacggacgacggtctacgaacttaagttccgtgggccggtacttaccgttaactttaccaacgttcgttagaacggtttacggttggggttacggttccggggcgggtaacgggtaaccttccggtaacccgttcggtaaccccggttccgttaacgggccaacccggtaacccggaacggtccgtccccggtcccccgttcgggttaacccttaaccgtttccccg

SEQ ID NO: 360653 - DNA, 540 bp, Homo sapiens
  misc_feature: GZ8MTXP01C9JE6.44.42.D09.1.454.CMB.2.raw
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
tcagacagtatatacacgaccggtgctcgatttagacacatacgcagggaaagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactggtccagcaatgacattgggagatataaccttgtctcctggtatcaacaacatccaggcaaagcccccaaatcatacttttgagtccagtgagcggccgtcaggtgtttctaactcgtcttctctggctcaagtctggccacacgcctccngtcgatctctggctccggctgagacgngctgactagtacgtgcggtctactatttacaacttcttagagtacgttgggtgttcgggaacggtgggacctcgaccgtcggtaccgttccgttcgggcctaacgaccccgaaggtcctcggcccccttcggttcctaacccg

SEQ ID NO: 360654 - DNA, 678 bp, Homo sapiens
  misc_feature: GZ8MTXP01DSLJE.44.42.D09.1.454.CMB.2.raw
tcagacagtatatacacgaccggtgctcgatttagacacatacgcaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactggtccagcaaatgacagttgggatatataaccttgtctctgtatacaacaacatccaggaccaaacgccccccaaaactctaactttactttttgacgttaccaggtgacgccggtccgtcgtaggttgtttctaatccgtcctttctcgtcggtcctaacccgtaattcgtcgggcccctaaccgacccgggtcccctcccgttcgtaccgtacttccgtcgtcgggtcccgtcccggtaccgttacggacgggacggtacgggtccttacgtaaccttattaccgtcggggtccggtcttaccttaactttactaaccttccgttggtacgtacggtttcgggggttcggtttccggggacgggtaacggtaccgttcgtaccgttcggtaacccgttcggttacggttccacggtcccgaacggtccgtacccgtccccgttccggtccttccgtttcccg

SEQ ID NO: 360655 - DNA, 599 bp, Homo sapiens
  misc_feature: GZ8MTXP01AEAM3.44.42.D09.1.454.CMB.2.raw
  modified_base (191)..(191): a, c, t, g, unknown or other
  misc_feature (191)..(191): n is a, c, g, or t
tcagacagtatatacacgaccggtgctcgatttagacacatacgcaggggaaaggggggggtcacaagaggcagcgctctcgggacgtctccaccatggcctgggctctgctgctcctcactctcctcactcaggacacagggtcctgggcccagtctgccctgactcagcctgcctccgtgtctggttcncctggacagtcgatcaccatctcctgcactgggtccagcaaatgacagttgggagatataaccttgtctctgtatacaaacaacatccaggacaaaaccgccccaaactctattacttttgagtccagtgagcggccgtgtaggttgtttactaactcgtcttctcgtggtacctccgtaagtctcgggacccaccgccggtcctcccgtgtcgtactcgtcgtcggcctccggccgtaggacggtacgaggcgtagacttacgttacggtcgcggtctactactttacaacttcgttaggacgttcgttggggttcggttcggggcgggagggttcctcaccgtcggtaacccgttcgttacggttccaacggacccgaacggcctccggcccctcggttcctcccg

SEQ ID NO: 360656 - DNA, 607 bp, Homo sapiens
  misc_feature: GZ8MTXP01EBZC3.44.42.D09.1.454.CMB.2.raw
  modified_base (244)..(244): a, c, t, g, unknown or other
  misc_feature (244)..(244): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcacgtgggtccagcaatgacagttggganatatacttgtctctgtatcaacaacatccaggacaaacgacccccaaatctattacttttgagtccagtgaggcggtcgtcgtaggttctttactaacgtcgtcttctctcggaccttaccgaagtcgtcgggacccacgtaccggtccctccgtgtcgtacttcgtcgtcgggccgtccggtccgtggacggcggaggctaggtacttagttacggtggccggtcttactaactttaccgtaacgttcgttaggtacgttacggtttgggttcggttcgggcgggtacggttctccgttaccgtcgtaccgttcgttcggttccgaacgtccgaaggtcctccggccccgtcggttcctccg

SEQ ID NO: 360657 - DNA, 523 bp, Homo sapiens
  misc_feature: GZ8MTXP01BKLYM.44.42.D09.1.454.CMB.2.raw
tcagacagtatatacacgaccggtgctcgatttagacacatacgcagggaaagggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaatcatacttttgagtccagtgagcggccgtcaggtgtttctaactcgcttctctggctccaagtctggccacacggcctcctgtcgatctctgggcctccggcctgaggacgaggctgactattacgtgtcggtctctaactttaccaacttcttagagtacgttgggtgttcgggcggagggctcaccgtgaccgttccaggttccaagcccaaggctcgcccctggttctccg

SEQ ID NO: 360658 - DNA, 539 bp, Homo sapiens
  misc_feature: GZ8MTXP01EXREX.44.42.D09.1.454.CMB.2.raw
  modified_base (235)..(235): a, c, t, g, unknown or other
  misc_feature (235)..(235): n is a, c, g, or t
tcagacagtatatacacgaccggtgctcgatttagacacatacgcaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctctgcactggtccagcaatgacattggganatataaccttgtctctggatcaacacatccaggcaaacgcccccaaatcaattacttttgacgtccagtgagcggcgtcaggtgtttcaatccgtcttctcgtgctaccaagtctggcccacacggcccttcccgtgtccgatctcgtcgggctccgggctaggacgggtacgaggctgacttattactgggcggtctctatttacaactcttgacgtcgttgggtgttcggcggtaagggcttcgaccgttgaccgtcgttaggttcacgcccgagcctcgccccgttcggtccttcgttccg

SEQ ID NO: 360659 - DNA, 613 bp, Homo sapiens
  misc_feature: GZ8MTXP01D86WR.44.42.D09.1.454.CMB.2.raw
  modified_base (339)..(339): a, c, t, g, unknown or other
  misc_feature (339)..(339): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatccaccatcctcctgcactgggccagcaatgactagttgggaagatataaccttgtctcctggtatcaacaacatccaggacaaacgaccccaaactctaattactttttgacgtccagtgagcggcgtctaggtntttactaactcgtcttctctcggtcctacctaagtctccgggtcccaccgtaccgggtcctccgtgtccattctcgtcgggcctccggcgtgaggacgacggctgtaacttacgttacggtcgtcggtcttactaactttaaccaacgtttccttagtagttaccggtttggggttcggttcggggaacggtagggcctcgaccgtcgtacccgttcgttcggttaccaacgtcccgaacggtcccgtcccgccccgttcggttccttaacccg

SEQ ID NO: 360660 - DNA, 699 bp, Homo sapiens
  misc_feature: GZ8MTXP01EMFRB.44.42.D09.1.454.CMB.2.raw
tcagacagtatatacacgaccggtgctcgatttagacacatacgcaggggaaaggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcatcaccatcctcctgcacgtgggtccagcaatgactagttgggaatatactaaccttgtactctaggtactacaacaactactaccgaaggaccaaaaccgaccccctaaaattcctaacttttactttttacggaacgttccgtaggttacggaacgggtcccgggtaccggttacgtagggtttacgttttacctaacgttccggtctttcgtccgtggtacccttaccgtaagtcctacgggccctaccgtaccgggtccccttcccgttgtaccgtacttccgtcggtcgggtcctacccgggtctagggacggtaccgggagccgtagtacttacgtttcgggcgtccgtacttcttaaactttaccgaactttgttaggtacgtacggtttcggggtcgttccgggcgggtaacggttcctaccgttacgtcggtaccgttcgttcggaccaacggtacccgaaggtccgtcccgccctcggttaacctccg

SEQ ID NO: 360661 - DNA, 526 bp, Homo sapiens
  misc_feature: GZ8MTXP01BCURS.44.42.D09.1.454.CMB.2.raw
  modified_base (415)..(415): a, c, t, g, unknown or other
  misc_feature (415)..(415): n is a, c, g, or t
tcagacagtatatacacgaccggtgctcgatttagacacatacgcagggaaaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaaatgacattgggagatataaccttgtctcctggtatcaaacaacatccaggcaaagcccccaaatcatacttttgagtccagtgagcgcgtcaggtgtttctaaatcgcttctctggctccaagtctgggccacacggcctccctgtcgatctctgggctcggctgagacgaggctgatatatgnggctcattactaacttctgtagtagttggtggtggtcggtaggacgtcttacgtcgtaccgttccgttcgttcgaacgaccgaacgcgtccgttccccgtccgttccgtcg

SEQ ID NO: 360662 - DNA, 669 bp, Homo sapiens
  misc_feature: GZ8MTXP01C5WXA.44.42.D09.1.454.CMB.2.raw
  modified_base (114)..(114): a, c, t, g, unknown or other
  misc_feature (114)..(114): n is a, c, g, or t
  modified_base (194)..(194): a, c, t, g, unknown or other
  misc_feature (194)..(194): n is a, c, g, or t
  modified_base (306)..(306): a, c, t, g, unknown or other
  misc_feature (306)..(306): n is a, c, g, or t
tcagacagtatatacacgaccggtgctcgatttagacacatacgcgaggggggggtcacaagaggcagcgctctcgggacgtctccaccaatggcctgggctctgctgctcctnactctcctcactcaggacacagggtcctgggccagtcctgccctgactcagcctgcctccgtgtctggttctcctggacngtcgatcaccatcctctgcacttgggccagcaatgactgttcggggatatagtaaccttgtctcctgatcaacacatccaaggacaaacgcccccaaatcgattacgttttnacgtccagtcgagtcgcgtcaggttcttctaacgtcccgtcttacgtcgtcggtccctaaccgaacgttccgtaccgggacccaaaccggtaaccccggggtccccttaccccgtcgtcccgacttccgtccggttcggggccttacccgggcccgtaagggacgggtacgcgggtctacgtacttagttacccgtggggcccggtactacttactttaaccaacttcgttcggtaacgtccgttaggggtgtccgggaggtaacggtacttcgaccgttacgtccccggttacttacggttccaccggaaccctaagggtcccttacccggtccccgttggtaacccttaaccgtttccccg

SEQ ID NO: 360663 - DNA, 555 bp, Homo sapiens
  misc_feature: GZ8MTXP02J0LEU.44.42.D09.1.454.CMB.2.raw
  modified_base (243)..(243): a, c, t, g, unknown or other
  misc_feature (243)..(243): n is a, c, g, or t
tcagacagtatatacacgaccggtgctcgatttagacacatacgcagggaaagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataaccttgtctcctggtatcaacaacatccaggacaaagcccccaaactcatacttttgagtccagtgagcggcgtcaggtgtttctaatcgtcttctctggctcagtctggccacacggcctcctgtcgatctctgggcctccggctgaggacgagctgactattactggcgtctcatttacaacttcttagacgtacgttgggtgttcggcgggtaggggacctccgacccgtcggtacccgtccgttacgggttaccgaagtacccccgaaagggtccctccggccccccttcggggtcctacccg

SEQ ID NO: 360664 - DNA, 524 bp, Homo sapiens
  misc_feature: GZ8MTXP02J1U6K.44.42.D09.1.454.CMB.2.raw
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacagtatatacacgaccggtgctcgatttagacacatacgcagggaaaggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaatcatacttttgagtccagtgagcggccgtcaggtgtttctaactcgcttctctggctcagtctggccacacggcctccctgtcgatctcgtgggcctccggcctgacggcgaggctgactattacngcgntctatttacaacttctgagtacgtttgggtgttcgggcggaggggacctcgacctcgacccgtcctaggtcaagccccaaggcctcgccccctcggtcctaccg

SEQ ID NO: 360665 - DNA, 568 bp, Homo sapiens
  misc_feature: GZ8MTXP02G5VP5.44.42.D09.1.454.CMB.2.raw
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataaccttgtctcctgtatcaacaacatccaggcaaacgcccccaaactctaattacttttgagtccagtgagcggccgtcaggttntttactaatccgtcttctctggctccaagtctcggccacgaccgcccttcctgtcgatctcgtcgggcctccggcctgacggacgaggctagacttattactgcgtctctactttacgaacttcgttagacgtcgttgggtgttcgggcgggtagggaccttcgaccgtcggtacccgttcgtaacggtccgacgaaccccgaacggtcctccggcccccgttcggtcctaccgtttcccgg

SEQ ID NO: 360666 - DNA, 512 bp, Homo sapiens
  misc_feature: GZ8MTXP02G9D6D.44.42.D09.1.454.CMB.2.raw
  modified_base (413)..(413): a, c, t, g, unknown or other
  misc_feature (413)..(413): n is a, c, g, or t
tcagacagtatatacacgaccggtgctcgatttagacacatacgcagggaaaggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaaactcatactttttgagtccagtgagcggccgtcaggtgtttctaatcgctttctctggctcagtctggccacacggcctcctgtcgatctctgggctccgctgaggacgagctgactattacngcgctcatttacaactcttagagacttgggtgttcggcgggaggactcgactcgaccgtcctaggtcaacgcccaaggctcgccccctacggcctaccg

SEQ ID NO: 360667 - DNA, 558 bp, Homo sapiens
  misc_feature: GZ8MTXP02H0W5O.44.42.D09.1.454.CMB.2.raw
  modified_base (237)..(237): a, c, t, g, unknown or other
  misc_feature (237)..(237): n is a, c, g, or t
  modified_base (370)..(370): a, c, t, g, unknown or other
  misc_feature (370)..(370): n is a, c, g, or t
  modified_base (527)..(527): a, c, t, g, unknown or other
  misc_feature (527)..(527): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataaccttgtctcctggtatcaacaacatccaggacaaacgccccaaactcatacttttgagtccagtgagcggccgtcaggtgttctaatccgcttctctgctcaagtctggccaccacggccctccctntccgatctcgtgggctcccggccttggacggacgaggctgactagttactgcggtctctaatttacaacttcttgtagtacgttggggtgttcgggcggtacgggacttcgaccgtggaacccgttccgtaacggtccacggaacccgaagggtccnccggtccccccgtcggtcctaccgtttcccg

SEQ ID NO: 360668 - DNA, 527 bp, Homo sapiens
  misc_feature: GZ8MTXP02GQ88R.44.42.D09.1.454.CMB.2.raw
tcagacagtatatacacgaccggtgctcgatttagacacatacgcagggaaagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttgggagatataacttgtctcctggtatcaacaacatccaggacaaacgcccccaaactcatacttttgagtccagtgagcggccgtcaggtgtttctaactcgcttctctggcttcagtctggccacaccgcctcctgtcgatctcgtcgggctcccggctggaggacgaggctgactattacgtgcgctctattacaacttcttgagtcttgggtgttcgggcggacgggtactcgactcgaccgtcgtaggtcaacgcccgaacggctccgcccccgtcggtcctccg

SEQ ID NO: 360669 - DNA, 504 bp, Homo sapiens
  misc_feature: GZ8MTXP02JA9FT.44.42.D09.1.454.CMB.2.raw
  modified_base (237)..(237): a, c, t, g, unknown or other
  misc_feature (237)..(237): n is a, c, g, or t
  modified_base (410)..(410): a, c, t, g, unknown or other
  misc_feature (410)..(410): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataaccttgtctcctggtatcaacaacatccaggcaaagcccccaaactcatacttttgagtccagtgagcggccgtcaggtgtttctaatccgtcttctctggctccaagtctgccacacgcctcctgtcgatctctggctccgcctgaggacgaggctgacttattacngcgctcatttaccaacttcttagagtacgttgggtcgttcggcggtagggctcgacctgaccgttctaggtcagccagctcgccctcgcactcg

SEQ ID NO: 360670 - DNA, 640 bp, Homo sapiens
  misc_feature: GZ8MTXP02FLJ9Y.44.42.D09.1.454.CMB.2.raw
  modified_base (505)..(505): a, c, t, g, unknown or other
  misc_feature (505)..(505): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcacatctcctgcactgggtccagcaatgacagttgggatatataaccttgtctcctgtactcaacaacatccaggacaaacgacccccaaaactctaatttaccttttgacgtccagtgacgcggtccgtcgtaggtgtttactaatccgtcttctctggtcctaccaagttcgtcggaccctacgacccgggtcccttcccgtgtaccgtacttccgttcggtcgggcccttcccgggcccttgggaacggtacggaggtctacgaacttagttaccgtcgcggtcttacctaactttacaaccttnttaggtaaggttccggttggggtcggtttcgggcgggtaacgggtcctcgaccgttacggacccgttacgtacgggtacacgggaaccccgtaaggtccctaccggccccccttagggtcctaccgtttccccgg

SEQ ID NO: 360671 - DNA, 631 bp, Homo sapiens
  misc_feature: GZ8MTXP02GEXL0.44.42.D09.1.454.CMB.2.raw
  modified_base (189)..(189): a, c, t, g, unknown or other
  misc_feature (189)..(189): n is a, c, g, or t
  modified_base (243)..(243): a, c, t, g, unknown or other
  misc_feature (243)..(243): n is a, c, g, or t
tcagacagtatatacacgaccggtgctcgatttagacacatacgcagggaaagggggggtcacaagaggcagcgctctcgggacgtctccaccatggcctgggctctgctgctcctcactctcctcactcaggacacagggtcctgggcccagtctgccctgactcagcctgcctccgtgtctggttcncctggacagtcatcaccatctcctgcacgtgggtccagcaatgacagttggganatataccttgtctctgtatcaacacatcagacaaacgaccccaaactcattacttttgacgtccagtgagccggccgtcgtaggttgtttactaacgtcgtcttctctggccttctagtctcggaccaccgaccgccctcctgtcgacttcctcgtcgggcctccggtctcggaacggacggcggctacgtaacttacttacgtggcgtaccttacttaatttaaacccgtaacttcgtttaggaacgttccggtttaggggtcggtttccggggacgggtaaacggggtaccttaccggtaaccgttcggtaccccgttacgtacggtaccgaaccggtaccccgaaacggtccctcccggtacccccgtttcgggtaccttacccg

SEQ ID NO: 360672 - DNA, 590 bp, Homo sapiens
  misc_feature: GZ8MTXP02IF5J4.44.42.D09.1.454.CMB.2.raw
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcncctgcactgggtccagcaatgacagttgggganatataacttgtctctgtatacaacaacatccaggacaaaacgccccaaactctaattacttttgatccagtgagcgcgtnagtnttctaatccgtcttctctgactccaagtctcggcacaccgccctcctgtcattccgtcgtcgggcctccggcctggacgggacgaggtctacgtacttacgttacgtgcggtcttactagtttaacacttcttaggtaacgttacggttggggtcgttacggggcggtacggggtacctaccgaccgttcggacccgttccgtacggttccaaccgggtaacccgaacggttccgtacccgttccccgttacggtcctaccgttcccg

SEQ ID NO: 360673 - DNA, 618 bp, Homo sapiens
  misc_feature: GZ8MTXP02IB7M6.44.42.D09.1.454.CMB.2.raw
  modified_base (463)..(463): a, c, t, g, unknown or other
  misc_feature (463)..(463): n is a, c, g, or t
tcagacagtatatacacgaccggtgctcgatttagacacatacgcagggaaaggggggtcacaagaggcagcgctctcgggacgtctccaccatggcctgggctctgctgctcctcactctcctcactcaggacacagggtcctgggcccagtctgccctgactcagcctgcctccgtgtctggttctctggacagtcgatcaccatctcctgcactgggtccagcaatgacagttggggagtatataaccttgtctcctggtatcaaacaacatccaaggaccaaaacgaccccccaaaactctaattactttttgacgtccagtgagcggccgtcgtaggttgtttctaatccgtcttctctggtctccctagtcctggccctaccgaccgccctcctgtcccgtatcctcgtcgggccctcccggccgtggacggacgaggtcctagacttatttaccgnggtcgtctactaactttacaacttcgttaggtacgttacgtttggggttcggttacgggtacgggtacggtcctaccgtaccgtcggtacccgttccgtacggtccaaccggacccgtaacggtccctcccggtcccccgttcggtaccctaccg

SEQ ID NO: 360674 - DNA, 609 bp, Homo sapiens
  misc_feature: GZ8MTXP02IS2JM.44.42.D09.1.454.CMB.2.raw
  modified_base (237)..(237): a, c, t, g, unknown or other
  misc_feature (237)..(237): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggganatataacttgtctctgtatcaacaacatccaggacaaacgcccccaaactcattacttttgacgtccagtgacgcggccgtcaggttgttactaatccgtcttctctcggctccaagtctgggccacgaccggccctcctggtcacttctccgtgggcctcccgggaccgtggaacgggacgagggctacggacttacttaaccgtggtcggtctactactttaaccaacttcttagagtacgtttggggttcgttcggggacggtacggggtactaccgtcccgtacggtacccggttaccgtacggtccaacggtaacccgaaccgggccgttccccggacccccgttcgggttaccctaccgtttcccg

SEQ ID NO: 360675 - DNA, 688 bp, Homo sapiens
  misc_feature: GZ8MTXP02JZSBU.44.42.D09.1.454.CMB.2.raw
  modified_base (182)..(182): a, c, t, g, unknown or other
  misc_feature (182)..(182): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (475)..(475): a, c, t, g, unknown or other
  misc_feature (475)..(475): n is a, c, g, or t
tcagacagtatatacacgaccggtgctcgatttagacacatacgcagggggggtcacaagaggcagcgctctcgggacgtctccaccatggcctgggctctgctgctcctcactctcctcactcaggacacagggtcctgggcccagtctgccctgactcagcctgcctcgtgtctggttcncctggacagtcgatcaccatctcctgcactgggtccagcaatgacattggggatatataacttgtctcctggtatcgaacaacatccaggcaaagccccaaatcatacttttnagttccagtgagcggccgtnagtgttcaatccggacttctctaggtctaccgtaagtccgtagggacccacaaccgggtcctaccccgtagtaccggaacttccgtactcgggggtacctacccgggtacctacgggacgggaaccgttaggggcctttacggaacttaacgtttaacgnggtaccggtactacgtacgttttaaccaaaccttccggtttacgaagggttaaccgtttagggggttcgttacccggggacgggtaacggggtaccttaccggaacccgtacggtaacccggttaccgtaacggggttacccaacgggtaaccccgaaaacgggtccgttacccggaaccccccgttcggggttaccccaacgtttcccccgg

SEQ ID NO: 360676 - DNA, 652 bp, Homo sapiens
  misc_feature: GZ8MTXP01CMARG.13.62.F07.1.454.CMB.2.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtntctccatcaccaatgatgattctaactggactggctccgccgacggtcccggagggggggccgtggaggtggtcgttgggacgcactctctacgaaaggcgggaccgaccgactactaacccgttntttaggagtccgagtctacgtactttacaaatacgaacaggtactaaagacactaacttcaccctgacggtcgaccttntagtcgtccggccggcggaccggcggtccgtctacgttcgtcgggtgcggcgaggtacttccgtacccggtcgaaacctcgttacggtgaaccgaacgggtaactaaaaccggttccgtaaacgttcggtttaaactcgttaaccgtttcggaccgtttcccggcgggggttaacccaacgggggtacccttgggttaacccaagggttcccg

SEQ ID NO: 360677 - DNA, 582 bp, Homo sapiens
  misc_feature: GZ8MTXP01CY6UN.13.62.F07.1.454.CMB.2.raw
  modified_base (234)..(234): a, c, t, g, unknown or other
  misc_feature (234)..(234): n is a, c, g, or t
  modified_base (355)..(355): a, c, t, g, unknown or other
  misc_feature (355)..(355): n is a, c, g, or t
  modified_base (541)..(541): a, c, t, g, unknown or other
  misc_feature (541)..(541): n is a, c, g, or t
  modified_base (558)..(558): a, c, t, g, unknown or other
  misc_feature (558)..(558): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtntctccatcaccaatgatgattctaactggaactggcctccgccgagggtcccggaggggggggcctgggagtggcgttggagcatctctacgaaggcgggacgaaccgactactaaccgtntttaggacgtccgagtctctatttcaaaattagaactaggtactaagacactaacttctccctgacgggttcaccttctagtggcggccgcgggaccggcggccgttctagttacgtgggtcgacgcgtaggactccgtccgtcggaacctgtccgtgacgaagcaaaacgttcgaagttcgttancttacgttcgactccgngggccaggacccnggtcgngtccg

SEQ ID NO: 360678 - DNA, 586 bp, Homo sapiens
  misc_feature: GZ8MTXP01BF4B5.13.62.F07.1.454.CMB.2.raw
  modified_base (234)..(234): a, c, t, g, unknown or other
  misc_feature (234)..(234): n is a, c, g, or t
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagacccctctccctcaattgcgtgatttccggntctccatcacaatgatgattctaactggaactggctccgcaggtcccgagggggggcctggagtggcttggaagcatctctcaaagcggacgaccgactactaaccgtntttaggagtcgagtctcgatttcaaatagaacaggtactaaagacactaacttctcccgtgacggtnacctctagtcgtacggccgcggacgcggccgtctagttactggggtcgcggcgaggtctcgtccgtacgaactcttcgtagaactaaggaacgaaaacgttcccggaaagttccgttaatccttacgttttgaccgtccgtggggaaccacggggaacccttcggtcgaacgtccg

SEQ ID NO: 360679 - DNA, 595 bp, Homo sapiens
  misc_feature: GZ8MTXP02GNZFW.13.62.F07.1.454.CMB.2.raw
  modified_base (234)..(234): a, c, t, g, unknown or other
  misc_feature (234)..(234): n is a, c, g, or t
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtntctccatcaccaatgatgattctaactggaactggctccgccaggtcccaggggggcctggagtggcttggaagcatctctcaaagcgggacgaccgactataacccgtntttaggagtccgagtctcgatttcaattagcaggtctaaagacacaattctccctgaggtgacctntatgtcgccgcggacacggccgtctattactgtcgcgcgagggactcctccggtacggaactcgttcgtagacaaggaccaaaaacggtccggtaaacgttaccgttaataccgtacgttttcgaaccgttcccggttacgggggacccgtaacgggggaaccccctggggtaccaacggtcccg

SEQ ID NO: 360680 - DNA, 687 bp, Homo sapiens
  misc_feature: GZ8MTXP02JQD9V.13.62.F07.1.454.CMB.2.raw
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacacgaccctctccctcaattgcgtgatttccggtgtctccatcaccaatgatgattctaactggaactgctccgccgaggtcccggagggggggcctgggagtcgggcgttaggaacgctatctactacgaaaacggccgggacgaccgactaacgtaacccgttgtttaggacgtccgtagtctacgtaatttcaaattacgacgtaggtactaaagtaccaactaaactttccgtacccgtgtaacggggtactaaccctcgttagtcggtccggccggtacggacgaaccgggtccttagtacttaccgtgtcgcgacgtagggacttccgtaccggtacggaacctcgttacggtacgaacgaaacggaaccgtaaaaaccgtccgggtaaaacgttccgttaaactccgttaaacgtttcgacccgttccggtacgggggaccctaaacgggggtaaccccctttgggaaccgcggttcccg

SEQ ID NO: 360681 - DNA, 722 bp, Homo sapiens
  misc_feature: GZ8MTXP02IASHN.13.62.F07.1.454.CMB.2.raw
  modified_base (237)..(237): a, c, t, g, unknown or other
  misc_feature (237)..(237): n is a, c, g, or t
  modified_base (417)..(417): a, c, t, g, unknown or other
  misc_feature (417)..(417): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcatgctggtgtcagctcccagaggggtcctgtcccaagtgcaactacaacagtcgggcccaggactgctgaagcctgcacacgacccctctccctcaattgcgtgtatttccggtntctccatcacaatgatgtatctaactggaactggctccgccacggtcccggagggggggcctggaggtggcgttggagcatctctacgaaaggcgggacgacgactactaacccgtcgtttaggacgtcgagtctacgtatttacaatagacgtaggtactaaacgactacaactttccncccgttagaacggggtcaccttcgtacgttcggtaccgggcccggaccggggaaccggtcccgggtacccgttactttaacgtttacccggttgggttcggaccggaccgggaaggtaccgttcccggttacccggtacggtaacccttacggtttccggtacgaaaccgaaacgggtaacccgtaaaacgggttcccgtaaaaggttccggtttaaaactccgttaaaacgttttcccgaaccggttccggtaccgggggtacccgtaaaccgggggtaacccccgtgggggtttaacccgcgg

SEQ ID NO: 360682 - DNA, 551 bp, Homo sapiens
  misc_feature: GZ8MTXP02FYXWG.13.62.F07.1.454.CMB.2.raw
  modified_base (234)..(234): a, c, t, g, unknown or other
  misc_feature (234)..(234): n is a, c, g, or t
  modified_base (347)..(347): a, c, t, g, unknown or other
  misc_feature (347)..(347): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtntctccatcaccaatgatgattctaactggaactggctccgccaggtcccgagggggggcctggagtggcttggaagcatctctacaaagcggacgaccgactactaacccgtntttaggagtccgagtctcgtatttcaatagacaggtactaaagaccactaattctccctgaggtcgacctctatgtcggccgcggacgcggccgtctattactgtcgcgcgaggatccgtcgtcggaactacttcgtagacaaggacaaaacgtcgaagtcgttatctacttgactcgtcgggacacgggaccctggcagtccg

SEQ ID NO: 360683 - DNA, 663 bp, Homo sapiens
  misc_feature: GZ8MTXP02GSPY6.13.62.F07.1.454.CMB.2.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
tcagtcacgtactacacgaccggtgctcgatttagtagtcgcataaaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagacccctctccctcaattgcgtgactttccggtgtctccatcaccaatgatgattctaactggaactggctccgccagggtcccgagggggggcctgggagtggcgttggaagcatctctacaaggcggacaccgactactacccgtntttacggntccgtatctcgatttacaattagcaggtactaagacacaatttcncccgtagagggtcacctgtatcgtcggacccggcggaccgcgggtaccgtcttagttactggtcgcgacggtagggacttcccgtaccgggtacgtaaaccgtaccgtttcgacgtaaacgaaaccgggtaaaccgtaaaaaccggttcccggtaaaacgtttccggttaaacttacccgtaacgtttcgaaacccgttccgggttaccggggtacccgtaaacggggtaacccccttgggtacctaacggttcccccg

SEQ ID NO: 360684 - DNA, 585 bp, Homo sapiens
  misc_feature: GZ8MTXP02FY7A3.13.62.F07.1.454.CMB.2.raw
  modified_base (235)..(235): a, c, t, g, unknown or other
  misc_feature (235)..(235): n is a, c, g, or t
  modified_base (350)..(350): a, c, t, g, unknown or other
  misc_feature (350)..(350): n is a, c, g, or t
tcagtcacgtactacacgaccggtgctcgatttagtagtcgcataaaagggaaagggtctgtgcaggcttcagcagtcctggacctcccgtgcaagaacatgaaacacctgtggttcttcctcctgctggtgtcagctcccagaggggtcctgtcccaagtgcaactacaacagtagggcccaggactgctgaagcctgcacagaccctctccctcaattgcgtgatttccggtntctcatcacaatgatgatctaactgaactggctccgccacggtcccgagggggggcctggagtggcgttggagcgatctctacaaacggcgggacgaccgactactaaacccgtnttttaggactccgattctcgtatttcaatagacaggtactaaagacactaaacttcctaccctggacggtcgacctctatcgtcggccgtacggcgccgctcgtattacgtgtcgcgtcgagggtatcccgtcggtacgaactacgttcgacgaacgaaggacaaaacgtccgaacgttcgttacgtctacttcgactccggtcggaccgtacgggaaccctggtaccaggtccc

SEQ ID NO: 360685 - DNA, 605 bp, Homo sapiens
  misc_feature: GZ8MTXP02FX9DL.13.62.F07.1.454.CMB.2.raw
  modified_base (234)..(234): a, c, t, g, unknown or other
  misc_feature (234)..(234): n is a, c, g, or t
  modified_base (555)..(555): a, c, t, g, unknown or other
  misc_feature (555)..(555): n is a, c, g, or t
  modified_base (598)..(598): a, c, t, g, unknown or other
  misc_feature (598)..(598): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtagggcccaggactgctgaagcctgcacagaccctctccctcaattgcgtgatttccggtntctcatcacaatgatgatctaactgaactgctccgccgacggtcccggaggggggcctggagtggcttggaagtcatctactacgaaagccgggacgaccgacgtaactaacccgtgtttaaggagtccgagtctacgtatttacaaattagacgagtactaaagaacctactaaacttcctaccctggtaggtacaccttgtatcggtccggccggcggacgcggtccgtcttaagttccgtgacgtcgacgaggtactccgtaccggtacgaacttcgtcgtagaacgaacggtacgtaaaacgtccgagttacttacnctacgttgactccggtacggaccgtaacggtacccgtggtacncgtaccg

SEQ ID NO: 360686 - DNA, 606 bp, Homo sapiens
  misc_feature: GZ8MTXP02G8UM4.13.62.F07.1.454.CMB.2.raw
  modified_base (236)..(236): a, c, t, g, unknown or other
  misc_feature (236)..(236): n is a, c, g, or t
  modified_base (490)..(490): a, c, t, g, unknown or other
  misc_feature (490)..(490): n is a, c, g, or t
  modified_base (598)..(598): a, c, t, g, unknown or other
  misc_feature (598)..(598): n is a, c, g, or t
tcagtcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggacttctgaagcctgcacacgaccctctcccctcaattgcgtgatttccggtntctccatcaccaatgatgattctaactgaactggctccgccacggtcccggaggggggcctggagtggcgttggaagcgatctctacgaaagcgggacgaccgactactaacccgtctttaggagtcgacgtctcgtatttacaatagaacgtaggtactaaagaacctaactaacttctaccctaggaacggtcgaacccttctagtcggtccggcccgcgggaccgccggtccgtactattacgtgtgccgngaaggctctccgtaggaacctacttcgagaacgaaggacaaaaccgtcgtaaagttcgttatactacgtttacgactaccgtggggaccacggggtaccctggtaccncgtcgtcg

SEQ ID NO: 360687 - DNA, 570 bp, Homo sapiens
  misc_feature: GZ8MTXP01BVENI.52.59.F04.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgganacagagtcaccatctcttggccgggnagtcaggtcattaacagttattagcctggtatcagacaaaacgaggcaagttccngaactctgatctatgacacactcctatttgactaatccgacggggtccagtctcggttcgttggcgtaggtgggtctgggactagtatttactctacacctancagcacgtctagcacgtcgtagaagtgttaggtactaacttaactttactttctacgttactaattaaactntagtatacgtacgtcccgtccccttacgtacccgttaccggttaccgggaacccgaaacgggaccttaacggtaacgtaaggtaaactaaccggaaacgttacggtcggttcgtaacg

SEQ ID NO: 360688 - DNA, 491 bp, Homo sapiens
  misc_feature: GZ8MTXP01DTTPT.52.59.F04.1.454.CMB.2.raw
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (474)..(474): a, c, t, g, unknown or other
  misc_feature (474)..(474): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccatcctccctgtctgcatctgttggagacagagtcaccatctctggccgggcagtcatgtcattaacagttattagcctggtatcagacaaaaaccagggcaaagttcctgaactcctgatctatgacacatcctactttgcaatccgaggggtcccatccgtcgggttcgttggctaggtgggtctggggactagtattttactctcacntcagcagcctgcagctagacntgttnctaacttattctgtcaatactatgatgaatcgcctcacgtcgttcgacgaggaccaagactggaacnaaacgtaacttgtaacg

SEQ ID NO: 360689 - DNA, 512 bp, Homo sapiens
  misc_feature: GZ8MTXP01DKEW5.52.59.F04.1.454.CMB.2.raw
  modified_base (275)..(275): a, c, t, g, unknown or other
  misc_feature (275)..(275): n is a, c, g, or t
  modified_base (362)..(362): a, c, t, g, unknown or other
  misc_feature (362)..(362): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcagtcaggtcattaacagttattagctggtatcaagacaaaacaggcaagttccngaactcctgatctatgacacatccactttgcaatccaggggtccatctcggttcttggcaggtgggtctggggactagtattttacnctcaccatcagcagcctgcagcctgaagtatggttagctaaactttatttctgtcaattaaactntgtatgatcgccccttnaccttacggttccggccaaaggggcccaaaggctaaggaaacttacaaaacggttactggttcggaac

SEQ ID NO: 360690 - DNA, 623 bp, Homo sapiens
  misc_feature: GZ8MTXP01DWYKZ.52.59.F04.1.454.CMB.2.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (399)..(399): a, c, t, g, unknown or other
  misc_feature (399)..(399): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgagacagagtcaccatctcgttggccgggnagtcaggtcattaacagttattagcctggtatcaagacaaaaaccgnggacaagttctagactctgatctatgacacactcctactttgactaacgtccgacggggtccagttccgtcgggtttccgttggccgtagggttgggtccgtaggggtaactaggttactttttaacccncctacaacctatacgacgcgacgtccgtcgaccgacgtacgtaagtaaacgttcgttacgggttacgttaactttaacgtttacgtttacgtacgttaacttaagttaaactagtacgtacgtacgtacctcccgtacccttacgtaaccgttaccggtaccggaaccgttaacggaccgttaaggtaacgtaaacgaactaacgaacgttacgtcgttcgtcg

SEQ ID NO: 360691 - DNA, 526 bp, Homo sapiens
  misc_feature: GZ8MTXP01BLWYQ.52.59.F04.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (262)..(262): a, c, t, g, unknown or other
  misc_feature (262)..(262): n is a, c, g, or t
  modified_base (365)..(365): a, c, t, g, unknown or other
  misc_feature (365)..(365): n is a, c, g, or t
  modified_base (434)..(434): a, c, t, g, unknown or other
  misc_feature (434)..(434): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgganacagagtcaccatctcttgccgggnagtcagtcattaacagttattagctggtatcagacaaaacnggacaagttcctgaactcctgatctatgacacatccactttgacaatccgaggggtccagtctcggttcgttggcgagtgggtctggggactagtattttacncttcaccatcagcacgctgcagcctagaagtattggttgacttaactttactttctgtactataaactntgatgaatcgccccttcacttccgttacggaccgaacggggttaccaaggtcctaaggaaactacgaaacgttaaccgtggttcggtaaccg

SEQ ID NO: 360692 - DNA, 583 bp, Homo sapiens
  misc_feature: GZ8MTXP01DSN3Y.52.59.F04.1.454.CMB.2.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
tcagcgcagtacgacacgaccggtgctcgatttagtacacacacttagggattgggggagtctctctcagccaggacacagcatggacatgagggtccctgctcagctcctgggacctcctgctgctctggctcccagataccagatgtgacatccagatgacccagtcctccatccctccctgtctgcatctggttgganacagagtcacntctctggccggnagtcaggtcattaactagttattagcctggtatcaagacaaaacgnggcaagttccagaactcctgatactatgacacactctactttgacaactcccgacggggttccacgttcgttccggtttcggtggtccgagggttcgggtcgtacggggactagtacttttaccnctcacctatcgagctaacgcctgaccgcgacgtagaaagtcgttgggttacgtaaccttaaaccttttttacgttacgttacgttaactaattaaacttgtaagtactcgtactcccgtacccttacgtaccgttacggtacgaacgaacggacaggtaataagtaactacgacgttacgtgttcgtc

SEQ ID NO: 360693 - DNA, 749 bp, Homo sapiens
  misc_feature: GZ8MTXP01DBI5T.52.59.F04.1.454.CMB.2.raw
  modified_base (220)..(220): a, c, t, g, unknown or other
  misc_feature (220)..(220): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatccctccctgtctgcatctgttggagacagagtcacatctctggccggngagtcaggtcattaactagttattagctggtatcaagaacaaaacgagggactaacgttcctagtaacctcctagtattctaatagaacctactacttacctactttcgactaaacgttccccgaacgggggttccctaagttccgttccggggttttacggttcgggtccgtaagggttcgggggttacgttacgggggtaacctaagggtttactttttaaccctacctttaccaacccgtacttaccgaacggtacccaacgtcccgttcggaccctaacggtaccccgttaaaggaaacggttacgtttagggggtttaaccgtaaccgttttaaacccgtttttaagtttttccccgttagttaacccttaaagtttaaaaccgttagttaactaagttacggtaaccttccgtaccccccttacgtaacccggttaccggtttacccgggaacccggttaaacgggaccaaacggtaacgtaaacggtaaacttaaccgaaacgttaccgttggaacggtccg

SEQ ID NO: 360694 - DNA, 556 bp, Homo sapiens
  misc_feature: GZ8MTXP01ECWIE.52.59.F04.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
  modified_base (373)..(373): a, c, t, g, unknown or other
  misc_feature (373)..(373): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgganacagagtcaccatctcttggccgggnagtcaggtcaattaacagttattagcctggtatcaagacaaaacgnggactaagtcctagaactcctgatctatgacacatcctacttgacaactccgacgggtccagtcgttcggttcgtgcgtagtgggtctgggactagtattttacnctcacctagtcagcacgtcctagcacgcctagaagtattaggggttactaacttaactttactttctatactaattaactatgtatcgattccgccccttagaccgttaccggttaccggaaccgaaacgggaccaagtaacgtaacggtaaaacttacgaaaacgttacgtgttaacggtcc

SEQ ID NO: 360695 - DNA, 569 bp, Homo sapiens
  misc_feature: GZ8MTXP01DPMZ8.52.59.F04.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (377)..(377): a, c, t, g, unknown or other
  misc_feature (377)..(377): n is a, c, g, or t
  modified_base (472)..(472): a, c, t, g, unknown or other
  misc_feature (472)..(472): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgctatctgttgganacagatcaccatctcgtggccgggnagtcaggtcattaacagttattagctggtatcagacaaaacaggacaagttccngaactcctgatctatgacaacatcctactttgacaatcccgacggggtcctattcgtcggttcgttggcgtaggtgggtcgtggggactagtacttttacnctcacatcagcagcctgcacgcctagaaagtattgggttacactttaaactttatttctgtacctaattaaatatgtattgatcctaccccttanaccgttacggttaccggaaccgttaaacggggaccaaacgggtctaacgggtaaaactacccggtaaaaacgttaaccgttgggttaacgggtcccg

SEQ ID NO: 360696 - DNA, 639 bp, Homo sapiens
  misc_feature: GZ8MTXP01ECKQ9.52.59.F04.1.454.CMB.2.raw
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (426)..(426): a, c, t, g, unknown or other
  misc_feature (426)..(426): n is a, c, g, or t
  modified_base (474)..(474): a, c, t, g, unknown or other
  misc_feature (474)..(474): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtctccactccctccctgtctgctatctggttggagacagagtcaccatcctcgttcgggccgggnagtcaggtctattaactagttattagcctggtatacgaagaacaaaacgngggactaagttcctagtacctcctgtatcttatagacctaactattaccctactttagactaacgttcccggacggggttcctagttccgttcgggttccgttaggccgtagggttggggtcgtaggggactagtacttttaccncttacacctaatcaacgctacggtccctgacacgccgttagaaacgtntttggggttactacttaactttatttccattactaattaacttataggtataggtccttaaccgtccccttacggtaaccttacccgggttaccgggaaccgttaaacgggttaaccttaagggttaacgaaacttaacgaaaacgtcgttagttcggctaaccg

SEQ ID NO: 360697 - DNA, 543 bp, Homo sapiens
  misc_feature: GZ8MTXP01EDNH3.52.59.F04.1.454.CMB.2.raw
  modified_base (225)..(225): a, c, t, g, unknown or other
  misc_feature (225)..(225): n is a, c, g, or t
  modified_base (418)..(418): a, c, t, g, unknown or other
  misc_feature (418)..(418): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgaccccagtctccatccctccctgtctgcatctggttggagacagagtcaccatctcttggccgggngagtcaggtcattaacagttattagcctggtatcagacaaaaaccagggacaagttcctagaactctgatctatgacacatcctactttgacaatccgacggggtccatcctcggttcgttggcgaggtgggtctgggtactagtattttactctcaccatcagcagcctgcagcctagaagtattggggttnacttaactttatttctgtctaattaactatgtatgactccgtcccttcacttacggttccggaaccgttaacgggaccaagaactaagggaaacttacgaaaacgttacgttcggttggtaaccg

SEQ ID NO: 360698 - DNA, 587 bp, Homo sapiens
  misc_feature: GZ8MTXP01B17T9.52.59.F04.1.454.CMB.2.raw
  modified_base (272)..(272): a, c, t, g, unknown or other
  misc_feature (272)..(272): n is a, c, g, or t
  modified_base (378)..(378): a, c, t, g, unknown or other
  misc_feature (378)..(378): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctccagataccagatgtgacatccagatgacccagtctccatcctccctgtctgcatctgttgagacagagtcaccatctcttggccgggcgagtcaggtctaattaactagttattagcctaggtatacaagacaaaaaccngggtacaagttcctagaactctgatctatgaacacatcctacttgacatccgacgggtcagtcgtcggttcgtggcgaggtgggtcgtgggactaggtactttacncttacaccatcagcacgctagctacgctagagtagttgggttacattaacctttatttccgtatacctaattaaacctgttagattggaactcccgaccccttactaaccgttaccggttaccgggaacccgttaaaacggggcccttaaacggtaacgtaacgggtaaaacttacccgaaaacgttaaccggtggttaacggtaaccg

SEQ ID NO: 360699 - DNA, 659 bp, Homo sapiens
  misc_feature: GZ8MTXP01CU5BP.52.59.F04.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (444)..(444): a, c, t, g, unknown or other
  misc_feature (444)..(444): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccatccctcctgtctgcatctgttgganacagatcacatctcgtggccggnagtcagtcattaactagttattagcctggtatacgaacgaacgaaaaaccgagggtactaacggtttccctacgtaaacctcccttagtaacttactaagtacgaacctaacctacttacccgtacttttacgactaacgtaccccgtacgggggtccctagtccgttaccgggtttcgttcgggcgtagggttggggtacgtggggactagttacttttaccnccttacacctatcgaagccagtccctgacaggtcctaggtacgtagttcggggttactacctttaaacctttattttaccggtagttacctaatttaaaccgtatagtatacgtacgtcccgtaccccttacgtaccggttaccggttaccgggaccgaacggggaaccttaggaaccttaaggaaactacgaaacgttacgtcggttgtaaccg

SEQ ID NO: 360700 - DNA, 580 bp, Homo sapiens
  misc_feature: GZ8MTXP01BRDX1.52.59.F04.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
tcagcgcagtacgacacgaccggtgctcgatttagtacacacacttagggattggggagtctctctcaaccaggacacagcatggacatgagggtccctgctcagctcctgggactcctgctgctctggctcccagataccagatgtgacatccagatgacccagtctccatcctccctgtctgcatctgttgganacagagtcaccatctcttgccgggnagtcaggtcattaacagttattagcctggtatcagacaaaacnggcaagttccngaactcctgatctatgacacatccactttgcatcgacgggtccatctcggttcgttggctggtgggtctggggactaggtactttactctcacatcagcagcctgcagcctagacgagttcgttacggacttaaactttactttccgttagtacctaattaaacgtattagtattaggaacttccgcccccttaacgaccggtaccggtttaccgggacccgttaaacgggggaccaaacggttccgttaaagggaaacctaaccgtaaaaccgggaaccgttgggtaacggttaaccgttccgg

SEQ ID NO: 360701 - DNA, 589 bp, Homo sapiens
  misc_feature: GZ8MTXP01DUL03.52.59.F04.1.454.CMB.2.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (371)..(371): a, c, t, g, unknown or other
  misc_feature (371)..(371): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttggccgggngagtcaggtcattaacagttattagcctggtatcaagacaaaaaccngggacaagttcctgaactcctgatctatgacacactccactttgcaatccgaggggtccatcgtcggttcgttggcaggtgggtctgggactagtatttacnctcaccatcagcagctgcagcctgaagtattgggttacgacttaaacctttatttctcgttacctaaattaaaccttattaggtaaatcggaacttaaccgtcccccttacgaaccgttaccggtttacccgggacccgaaaacgggggttacccaaaacggtcgttaaacggggaaacttaacccgaaacgttaaaccgttggttcggggtaacccg

SEQ ID NO: 360702 - DNA, 580 bp, Homo sapiens
  misc_feature: GZ8MTXP01COWC3.52.59.F04.1.454.CMB.2.raw
  modified_base (223)..(223): a, c, t, g, unknown or other
  misc_feature (223)..(223): n is a, c, g, or t
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatccctccctgtctgcatctgttggagacagagtcaccatctcgttgccgggnagtcaggtctattaacagttattagcctggtatcagacaaaacagggactaagttcctgaactcctgatctatgacaacatcctactttgacaagtcccgaggggtccagtccgttcggttcggttggcgtaggtggggtctggggactagttatttactctacactatcagcacgcctgcagcctagaatnttggttgtacttaacttnttctgtactattaacgtntagatgaactccgtccccttacgtaccttaccgggttaccgggaccgaaacgggggaacccttaacgggtaacgtaaacgggtaaaacttacccggaaaaacggttaaccgttggttaacggggtaacc

SEQ ID NO: 360703 - DNA, 656 bp, Homo sapiens
  misc_feature: GZ8MTXP01DFUAF.52.59.F04.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtctccatccctccctgtctgcatctgttgganacagatcacatctcgtgccgggnagtcagtcattaactagttattagctaggtatcaagaacaaaacgaggactaagttcctagtaactcctagtacttactatgaacctactactaccttactttacgactaacttaccccggacggggtccctaagttcccgttacgggtttaccggttggtcgtagggttacggggtcgttagggggtactaaggttacttttaccaccttacaacctatacgaacggctaacggtcctaggaccacgggtacctaggtaaacgtgttacggtttacggtaactttaaaccttttattacgttactactaaattaaactgtagtatcgtactaacccgtcccttacgtaacgaccggttaccgaaccggaaagggttaccaaacggtcgtaaaacgaaacgtaaccggtaaacgttacgttcggttcggtaaccg

SEQ ID NO: 360704 - DNA, 682 bp, Homo sapiens
  misc_feature: GZ8MTXP01EEKFA.52.59.F04.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggcctcccagataccagatgtgacatccagatgacccagtcctccactccctccctgtctgctatctggtgganacagagtcactatctcgtggccggngagtcaggtctaattaactagttattgctagtatacaacgaacaaacgnggactaacgttccagtaactcctagtacttactactacgacaactacttacctactttacggactaacgtccccggacggggttacctagtttccggtcgggttttacggtcgggtcgtagggttcgggttcgaggggtaacttacgggttacttttaccctacctactaacctacgtaccaacgtaccgtaccgtccgttacggacctaacgggtcctaaaggtaagtacgtttagttacgtaactttaaaccttttcgttacgtagtaacttaattaactagtagtacttacgaccgtcccgtaacccttcccgtaaccggttaccggtaaccggtaaccggaaacggttaccgaagaacgtaaacgtaaacgaacggtaaacggttcgtcggttaacgtaacc

SEQ ID NO: 360705 - DNA, 663 bp, Homo sapiens
  misc_feature: GZ8MTXP01EODDD.52.59.F04.1.454.CMB.2.raw
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccactccctccctgtctgctattctggttggagacagactcacctatctcgttcgggccgggngagtccaggtctaattactagttattagctgtactacaacgaacaaaaccgnggactaacgttcctagtaacctctagtactactatcgaacctactactacctactttcgactaacgtccggtaccgggtacctagttccgttcggttacgttcgggcgtaggttcggggtcgtacgggtactaggttacttttactctacctactagtcacgcgtacgtcgtgaccgtacgtaccgtaagtaacgttcgtttaggttacgtaactttaaactttcgtttactacgttactaaagttaactagttagtagttcaacccgtccgtccccttagtaacccggttaccggtaccgggaaaccgttaacggaaccttaacggtaacgtaaaacggtaactaaaccggaaacgttacggtaacgttcggtaaccg

SEQ ID NO: 360706 - DNA, 537 bp, Homo sapiens
  misc_feature: GZ8MTXP01BFWT7.52.59.F04.1.454.CMB.2.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (416)..(416): a, c, t, g, unknown or other
  misc_feature (416)..(416): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccatcctccctgtctgcatctgttgganacagngtcaccatctcgttgccgggnagtcaggtcattaacagttattgcctggtatcagacaaaaccagggctaagtcctagaacctcctgatctatagacacatcctactttgactaatccagggtccagtccgtcggttcgtgcgtagtgggtcgtggactaggtatttctctacaccatcatacagccctgaccagcctagaagtctggggttanaccttaaattgtttacctgtacctattaaacctgtagtatgacttccggccccttagtaccgacgttccggaaccttaagggaccaagtctaggaaactacgaacgaagtcgttggtaacc

SEQ ID NO: 360707 - DNA, 663 bp, Homo sapiens
  misc_feature: GZ8MTXP01EA3EM.52.59.F04.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (449)..(449): a, c, t, g, unknown or other
  misc_feature (449)..(449): n is a, c, g, or t
  modified_base (555)..(555): a, c, t, g, unknown or other
  misc_feature (555)..(555): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatcgacccagtcctccactccctccctgtctgctatctggtgganacagatccactatctcgttcggccgggngagtcgagtctaattaactagtttacttcgccttaggtactacgaaacgaaccgaaaaaccggtcgggtaccttaaacgttccctaaggtaacccttccgtagtacttactaagtcaactactactaccttacttagactagtcccggaccgggttcctagttccggttcggtttcgtggtcgtagggtcgggtcgtacgggtacttaggttacttttcnctcactagtcagtccgtacgtccctagaccgtacgacgtaagtaagttcgttaggggtttacctaactttaaactttttcttcgtacttaactaatttaaacgttntccggtaattacggtacctcccttaacccttgtaaacccggttaccgtccggaaaccggaacggccaggtaaccttaaggaactacgaaacgttgttcggcggtaacc

SEQ ID NO: 360708 - DNA, 766 bp, Homo sapiens
  misc_feature: GZ8MTXP01DQHBN.52.59.F04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (344)..(344): a, c, t, g, unknown or other
  misc_feature (344)..(344): n is a, c, g, or t
  modified_base (451)..(451): a, c, t, g, unknown or other
  misc_feature (451)..(451): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatcgacccagtcctccactccctccctgtctgctatctggtgganacagagtcacatctcgtcggccggnagtcaggtacattaactagttattacgctaggtatacaagaaccaaaacgagggactaacgttcctagtaaccttcctagtacttactactacgacctaactacttacctacgtttanactaacgtacccggtaccgggggtcctagtttccggtcgggtttacggttgggtcggtaggggttcggggttacgtacgggggtaaactacggtttaacttttaccnccttactaacctactccgacgtaccaggtcccttaggacctacgggacctaggaaaggttcttcgggggtttaaactaccttttaaaacctttttacttaccgtaacgttaactaaacgtttaaactgttacgtaacttccggttacccttaaccccggtaccccttaacccgggtaaacccgggttaccccggggttaaacccggggaacccgggttaaaaccggggttaaccgttaaaacgggtaacccgggtaaaacgtaaaaccggtaaaaccggtaaacgggttacggttaaccggggttaacgtaaccg

SEQ ID NO: 360709 - DNA, 599 bp, Homo sapiens
  misc_feature: GZ8MTXP01A71SY.52.59.F04.1.454.CMB.2.raw
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgaccccagtcctccatccctccctgtctgctatctggttggagacagagtccacctattcctcgtggccgggnagtcaggtcaattaacagttattagcctggtatcagacaaaacgnggacagttccngaactctgatctangacactactctactttgactaactccgacggggtccagtccgtggttcgttgggcctagggtcgggtcgtaggactagtatttctctacacctatcacgcacgtcctgcacgtccgtagaaaggttnttacggttactaactttaatttactttactagtactaattaactagttgtactacgtacctcccgtacccgttacgtacccggttaccggtaacccgggaaccggaaacgggttaccgttaacggtaaccgtaaagtaaaccgtaacgtaacgttacgttcggttcgaacg

SEQ ID NO: 360710 - DNA, 552 bp, Homo sapiens
  misc_feature: GZ8MTXP01ALT6L.52.59.F04.1.454.CMB.2.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
  modified_base (434)..(434): a, c, t, g, unknown or other
  misc_feature (434)..(434): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttggccgggnagtcaggtcattaacagttattagcctggtatcagacaaaaacnggacagttccagaacctcctgatctatgacactatccactttncaatccgacggggtcctagtcgtcggttcgttcggcgtagtggggtctgggactagtattttacccnctacacatcagcgacgcngcacgtctagagtagtcggtactacttacttacgttctntactaattaacgtagtagtatcgtactccgtcccttaccgtaccggttaccggtaccggaacgaacgggacaacggtaacgtaagtaaccgtaacgaaacgttacgtcggttcgaacg

SEQ ID NO: 360711 - DNA, 810 bp, Homo sapiens
  misc_feature: GZ8MTXP01CS74D.52.59.F04.1.454.CMB.2.raw
  modified_base (646)..(646): a, c, t, g, unknown or other
  misc_feature (646)..(646): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatcgacccagtcctcctactccctccctgtctgctatctggttaggagtacagacgtcacctatctcgttcgggccggggcgtagtaccgtaggtactaatttaactagtttacttacgccgttaggtatacgaacgaaaccgaaaaccgcgggtacttaacgttccgtacgtaaccttccgtagtacttactagtactaacctactacgttacccttacgtttacgacctaaacggtccccggtaccggggttacccttacggtttacccgggtttccggggtttaccgggttcgggtcggggttacggggtttaccgggggttaccgggttacggggtaaccgttaaggtttttacccttttaacccttacccggttaacccgtacctacgttaccgacgtaccggtaaccggtccgtacgtaccgtacgttccgtaaaggtaaccgtttaggttacgtttacgtaacctttttaatttacccgtttntacttaactatttaacgtattacggtattccggtaaccttcccgtaccccgacgtaccccgggttaaacggtccccgggaaacggttaaacccgggaccgttaacggtaaaccgtaaacgtaacccggttaaaaacgtaccgggttacgtccggttcgtaaccg

SEQ ID NO: 360712 - DNA, 542 bp, Homo sapiens
  misc_feature: GZ8MTXP01A1O58.52.59.F04.1.454.CMB.2.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
  modified_base (401)..(401): a, c, t, g, unknown or other
  misc_feature (401)..(401): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctccagataccagatgtgacatcagatgacccagtctccatcctccctgtctgcatctgttggagacagagtcaccatctctggccgggcagtcaggtcagttaacagttattagctgtatcaagacaaaaacngggacaagttcctgaactctgatcatgacanatcattgcatccgagggtccagtcgtcggttcgttggctaggtgggtcgtagggacgtagtacttttacnctcaccataccagcaggcctggcagcctagaaagtntgggttagaccttaaatttagtttcctgtaccaattaaatatgtaatggaactcgtccccttgtaccacgttccggaaccgaaacggggaccaacggaacgttaggaaaacttaccaaacggttaaacgtgttaagggtcc

SEQ ID NO: 360713 - DNA, 704 bp, Homo sapiens
  misc_feature: GZ8MTXP01DD9EQ.52.59.F04.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctccagataccagatgtgacatccagatcgaccccagtcctccatccctcctgtcctgcatcgtggttagacganagacgtccaccattcgtcgttcggccgggntagtctaaggtactaattaactagttacttagccgtaggtatacaaagtaacgaaaaaccgngggtactaaggttcctacgtaactcctagatctaatagacctanacttctactttcgactaactcccggtacgggtacctagttccgttacgggttcgttacggcgtagggtcgggtacgtacgggactagttactttccacttaccgactataccgagtacgacgtccgtgacctaggacctaaggaaagttcgttagggttacgttaaacctttaacctttaagtttctaaccgttaactaaagtttaaaccgttaattacggtagttacgtaccgttaaccccgtacccttaaccggttaaacccggttaccgggtttaaacccggaaccggaaaccggggttaaccaaagggtaacccgtaaaaggaacttaaaacgaaccggttagaacggttaacggaaccg

SEQ ID NO: 360714 - DNA, 604 bp, Homo sapiens
  misc_feature: GZ8MTXP01E1OJB.52.59.F04.1.454.CMB.2.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatcgacccagtcctccactccctccctgtctgctatctgtgganacagntcaccattctcgtcggccgggctagtcgaggtactaattaactagtttattacgcgtaggtatcaagaaaccaaaacggnggactaacgttcctagaacctctagacttctagtacaaccactacgtcctattcgactacgtccggacgggtcctagttcgtcggttaccgtggcgtagggtcgggtgcgggtaataggttacttttacaccttacacctatcgacngtacncggtacncgacgcgtaagagtcttacggtacgttacttactttacgtctacgtaactaagttactgtacgtcgtaccgtacgtcccgtaccttcggtaaccgttacggtaccggaacgaacggacttagtaacgtaataaccgaacgtacggttcgtcggttcgtc

SEQ ID NO: 360715 - DNA, 593 bp, Homo sapiens
  misc_feature: GZ8MTXP01CE1TO.52.59.F04.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtctccatcctccctgtctgcatctgtgagacagatcaccatctntgcggnagtcagtcatacagttattgctgtancagacaaaaccgaggcaagtcngaactcctgatctatcgacactatacctacgtttnactaaagtcccgacggggtacctagtccgttcgggttacgttggngagtggggtactggggactagttacttttacccnctacacctagtcacgcacgtctagacgacgtactaaggaagttattggttactaactttaattactttacgtacgttaactaaagtttaactaagtagaattccgactcccgtcccgttacgaaacccgttacggtacggaaaccgaaacggggaaccttaaacgtaacgtaaaacggaaaactaaaccaaaacggttacgttaaggttcgtaac

SEQ ID NO: 360716 - DNA, 597 bp, Homo sapiens
  misc_feature: GZ8MTXP01CX6US.52.59.F04.1.454.CMB.2.raw
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtcnccatccctcctgtctgcatctgttgganacagntcactatctcgtggccggnagtcaggtcaattaactagttattgctgatcaanaacaaaacgnggtacaattccganactctagatactagtnaactaacacttacctactttagactaacgtaccgaccggggttacctagttcccgttcgggttaacgtgggtcgtagggttcgggtacgtagggtactacgttatttacctctacactatcacgacaagtcctagacgactacgtagaagtcggttntaacgtaccttattacgttccgtntaactattaaactntagtactnatcccgacttccgaaccgttccggttaacggaccgttaacgggaccaaacgtaacgtaaacggtaacaaccgtaaacgttacgttaacggcgttaaccg

SEQ ID NO: 360717 - DNA, 581 bp, Homo sapiens
  misc_feature: GZ8MTXP02H05WC.52.59.F04.1.454.CMB.2.raw
  modified_base (219)..(219): a, c, t, g, unknown or other
  misc_feature (219)..(219): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgttggagacagatcaccatctcttgccgggnagtcagtctattaactagttattagctgtatcaagaacaaaacgaggactaagttcctagtactctagatctatgacactactcctacttcgactatccgacgggtaccctagtccgttcggttcgttcggcgtagggtcgggtcgtgggtactagttacttttactctacacctatcagacacgcctgacacgtctagaagtattagttcgtactaacttactttacttacgtactaattaactatagtatacgtactaccgtaccctacctaccgtaccggttaccggtaccgtaaaccggtaaccgaacgtaacgtaacggtaaacgtaaacgtaaaacgtaacgtacggtacggtacg

SEQ ID NO: 360718 - DNA, 533 bp, Homo sapiens
  misc_feature: GZ8MTXP02HLIUI.52.59.F04.1.454.CMB.2.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgttggagacagagtcaccatctcttgccgggcgagtcaggtcattaacagttatttagctggtatcagacaaaaccnggacaagttccngaactcctgatctatgacacatccactttgcaatccgaacggggtcccatcgtcggtttcgttggcgtagtgggtcgtgggactagtattttacnctcacctatcagcagccctgcagcctagaaagtnttggttntactaactttatttctgtactataattatagtagtgtactactccctcctactacgttacggaccgaacggaaccgaacgtaaccgtagaaacgtaacgaaacgtaacctacgtaggtcg

SEQ ID NO: 360719 - DNA, 578 bp, Homo sapiens
  misc_feature: GZ8MTXP02H0JYO.52.59.F04.1.454.CMB.2.raw
  modified_base (200)..(200): a, c, t, g, unknown or other
  misc_feature (200)..(200): n is a, c, g, or t
  modified_base (255)..(255): a, c, t, g, unknown or other
  misc_feature (255)..(255): n is a, c, g, or t
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgaccccagtcctccatccctccctgtctgcatctgttgganacagatcacatctctggccggcagtcagtcattaacagttattagctggtatcanacaaaacagggcaagttcctagaactcctagatctatgacacactcctactttcgactaacgtcccgtacggggtacccctagttccgttcgggtttcggttcggcgtaggttgggtcgtgggtacctagttacttttactctcaccctatacagctagccctgccgacgccgtagaagtacttggttacgtacttaactttattcctagtacctaattaactatagtatgtactccgacccttacaccgtacggttccggaccgaacgggaccctaagaacgttacggaaaactaccgaaaacgtaacgtggttacggtacc

SEQ ID NO: 360720 - DNA, 601 bp, Homo sapiens
  misc_feature: GZ8MTXP02JXY8C.52.59.F04.1.454.CMB.2.raw
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgaccagtctccactcctccctcgtctgcatctgttggagacagagtctaccactcttcttcggtccgggcggagtcgacggtacgtattaaactagttatttagtcctggtactacaacgacaaaaaccgaaggcgaagttacctcgaactacctgtatctatacgacactactactaccttgtactacaccgtacggggtaccctacttcgttcggttcggttcggcgtacgtggggtcgtaggggactagttactttactcctacaccatcacgcgacgccctgaccagccgttagaaaggtattgttacgtactaaactttatttcctgttaactaattaactaattgaatctagtacccgttcccactaccgtaaacggttcggaccgaaacgggacctaaagcgttaaaggaaacaccgaaagaacgtttggacgtcg

SEQ ID NO: 360721 - DNA, 497 bp, Homo sapiens
  misc_feature: GZ8MTXP02GK1C9.52.59.F04.1.454.CMB.2.raw
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (449)..(449): a, c, t, g, unknown or other
  misc_feature (449)..(449): n is a, c, g, or t
  modified_base (492)..(492): a, c, t, g, unknown or other
  misc_feature (492)..(492): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttattagcctggtatcagacaaaaaccaggcaaagttcctgaactcctgatctatgacacatccactttgcaatccaggggtcccatcttcggttcgttggcgtaggtgggtcgtggggactaggtattttacnctcacatcagcagccctgcagcctagaagtatgttagctaactttntttctgtcaataactatgatgatcgccctnactcgtcgacgaacggacagctaggaaactacaaacgactcgnggtac

SEQ ID NO: 360722 - DNA, 551 bp, Homo sapiens
  misc_feature: GZ8MTXP02FEKF1.52.59.F04.1.454.CMB.2.raw
  modified_base (220)..(220): a, c, t, g, unknown or other
  misc_feature (220)..(220): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctctgccgggnagtcaggtcattaacagttatttagcctggtatcagcaaaaaacccagggacaagttcctgaactcctgatctatgacacatccacttgcaatccaggggtcccatcttcggttcgttggcagtgggtctgggacagtattttacnctcaccatcagcancctgcngacctgaaagatgttcgactaaacctttattttctcgttactaattaaactataggaattggaactcgcccccttcaaccgtaaacggtttccggacccgtaaaacggggacccaaaaggccgttaaggaaaactaccgaaaacgtaaaacgtgttacgggtccg

SEQ ID NO: 360723 - DNA, 541 bp, Homo sapiens
  misc_feature: GZ8MTXP02JPNBL.52.59.F04.1.454.CMB.2.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgganacagagtcaccatctcttgccgggcgagtcaggtcattaacagttattagcctggtatcagacaaaacgnggacaagttcctgaactcctgatctatgacactatcctactttgactaatccgacggggtcccatccgtcggttcgttggctagggtgggtcgtggggactagtattttactctcaccatcagcagtcccgtgaccagccgtagaaagtnttagttgtacttaaactttntttcgtgttacctaattaactatgtaatgacttacgccctanaccgtacgtacggaccgaacgggtaccaaggcgtaaggaaactacgaaacgtactgtggaccg

SEQ ID NO: 360724 - DNA, 573 bp, Homo sapiens
  misc_feature: GZ8MTXP02JB1LF.52.59.F04.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttgganacagagtcaccatctcttgccgggnagtcaggtcattaacagttattagcctggtatcagacaaaaccngggacaagttccngaactcctgatctatgtacacatccactttgactaatccgacggggtccatcttcggttcgttggcgagtgggtctgggacagtatttacnctcaccatcagcagcctgcacgtcctagaaagtgttggttacgtctaaacctttttattactacgttactaagttaacttagtagtagtacgtacgtacccgtacccgtaccgaccgttaccggttaccggaaccggtaaaccggaaccgtaaacggtaacgtaaacgtaaacgtaaccgtaaacggtacgtacggtacgtacg

SEQ ID NO: 360725 - DNA, 604 bp, Homo sapiens
  misc_feature: GZ8MTXP02I01GE.52.59.F04.1.454.CMB.2.raw
  modified_base (216)..(216): a, c, t, g, unknown or other
  misc_feature (216)..(216): n is a, c, g, or t
  modified_base (379)..(379): a, c, t, g, unknown or other
  misc_feature (379)..(379): n is a, c, g, or t
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgtgagacagagtcacatctctgccggngagtcaggtcattaacagttattagcctggtatcagacaaaaaccgaggacaagttcctagaactcctgatctatgacacactccactttgactaatccgacggggtccctatccgtacggttcggttgcgtagttgggtcgtagggactagtagttttaccnctaccaacctactacacgacgacgtcccttgcgtacgtacctagaaacgtattgggttacgtacttaaactttagtttacttcggtactaaattaacttaagtgtaagtctacgttacccgtaccctaccaaccggtaccggttaccggaacccgaaacgggtaccaaaggtcccgtaaaggtaaaaccgtaacgaaaaccggtacgttacggtacggtaacccg

SEQ ID NO: 360726 - DNA, 609 bp, Homo sapiens
  misc_feature: GZ8MTXP02IMSZX.52.59.F04.1.454.CMB.2.raw
  modified_base (200)..(200): a, c, t, g, unknown or other
  modified_base (393)..(393): a, c, t, g, unknown or other
  modified_base (431)..(431): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatcgacccagtcctccatccctccctgtctgctatctgttgganacagagtcaccatctcgttggccgggcagtcgaggtcattaacagttattagcctggtatcagaactaaaaaccgagggactaacgttcctagaactccgtgtatctatgaacacatcctactttgactaatcccgacggggtcccagtcttcggttcgttggccgtaggtggtcgtgggactagtattttcncttcactatcagtcagtcctgccacgcctaggaaagtnttgttacgtataacctttatttcctagttacctaaattaaacctagttagtagtgaaccttacggtacccccttacgtaacctaaccggtttccgggaaacccgaaaacggttacccgaaaaggtccgtaaaacgggaaaacttacccggaaaaacgtacgtacggttacggtacccg

SEQ ID NO: 360727 - DNA, 542 bp, Homo sapiens
  misc_feature: GZ8MTXP02GVGDO.52.59.F04.1.454.CMB.2.raw
  modified_base (216)..(216): a, c, t, g, unknown or other
  modified_base (251)..(251): a, c, t, g, unknown or other
  modified_base (259)..(259): a, c, t, g, unknown or other
  modified_base (270)..(270): a, c, t, g, unknown or other
  modified_base (281)..(281): a, c, t, g, unknown or other
  modified_base (357)..(357): a, c, t, g, unknown or other
  modified_base (388)..(388): a, c, t, g, unknown or other
  modified_base (393)..(393): a, c, t, g, unknown or other
  modified_base (405)..(405): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgtggagacagagtcacatctctgccggnagtcaggtcattaacagttattagcctggtatcanacaaaacnggacaagtccngaactctgatntatgacacatccatttgactatccgacgggtccatcttcggttcgtggcgtagtggtcgtgggactagtatttacnctcaccatcagcagcctgcagcctgaaagtntgttnactatttattcngtacaataactatagattacgacttccgccccttacgaccgtaccggttaccggacccgtaaaacggggtacccaaaggtaacccgttaaagggaaaaccttacgaaaaacccggtaacgtgggttacggtaacccg

SEQ ID NO: 360728 - DNA, 500 bp, Homo sapiens
  misc_feature: GZ8MTXP02HXU6Q.52.59.F04.1.454.CMB.2.raw
  modified_base (210)..(210): a, c, t, g, unknown or other
  modified_base (451)..(451): a, c, t, g, unknown or other
  modified_base (456)..(456): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgtggagacagagtcaccatctnttgccgggcagtcaggtcataacagttattagctgtatcagacaaaaccagggacaagtcctgaactcctgatctatgacaacatccaactttgactaagtccgacggggtccctactcgttcggttcgttggcgtaggtgggtcgtggggtacagtacttttactctacaccatcagcagcctgcacgcctagaagtatgttgtactaatttatttctgtactataactatgatgactcnccctnacacgtacgacgaacggacagcgtagaactacaacgactgtagc

SEQ ID NO: 360729 - DNA, 742 bp, Homo sapiens
  misc_feature: GZ8MTXP02IZ4OL.52.59.F04.1.454.CMB.2.raw
  modified_base (198)..(198): a, c, t, g, unknown or other
  modified_base (225)..(225): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccatccctccctgtctgcatctgttgganacagagtcaccatctcttggcccgggngagtcaggtctaattaactagtttattagccttaggtatacgaagaaccaaaacgagggactaacgtttccagaacctcctgatctatcgaactactacttccctaatttgactaacgtcccggtacggggtccctagttccgttcggtttccggttgggccgtaggttcggggttcgtaggggacttaacggttactttttacctctacctaacctactacgaacgtcgacgtcccgttaggccaacgtacccgtaggaaaagttacgtttcgggttacgtaaacctttaaacccgtttttagttttccccgttagtttaaccctaaactttaaacgtttaaattggttaaagtcgtaaccgtttccccgacccccttaccggtaaacccgttaccggggttaacccgggaaaccggttaaaaaccggggaccccttaaaaagggccgtttaaaaacgggaaaactttaaaccgaaaaaaccggggtttaaccttcggggtttaaccggtaacccg

SEQ ID NO: 360730 - DNA, 620 bp, Homo sapiens
  misc_feature: GZ8MTXP02I4P9B.52.59.F04.1.454.CMB.2.raw
  modified_base (222)..(222): a, c, t, g, unknown or other
  modified_base (230)..(230): a, c, t, g, unknown or other
  modified_base (253)..(253): a, c, t, g, unknown or other
  modified_base (273)..(273): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatccctccctgtctgcatctgttggagacagagtcaccatctcttgccgggnagtcagtnataactagttattgctgtatcanacaaacgaggactagtctanactctgtatctatcacactactcctattcactactcccgacgggtaccctagtccgttcggttcgttggtcgtagggttcgggtcgtagggtactagttactttacctcgtaccaacctatcgacgccgacgtccctcgaccgtacgtaccgtaggtaaacgtagtttacggttacgtacctttaacgtttacgtttacgttacgttactaaacttaacgttatacgtagtacgtacgttaccgtacccgtaccgtaccgtaaccggtaccggtaaccgtaaaccggtaaccgtaacgtaacgtaaacggtaaacgtaaacgtaaaaccgtaacgtacgtacgtacg

SEQ ID NO: 360731 - DNA, 619 bp, Homo sapiens
  misc_feature: GZ8MTXP02GU57A.52.59.F04.1.454.CMB.2.raw
  modified_base (196)..(196): a, c, t, g, unknown or other
  modified_base (206)..(206): a, c, t, g, unknown or other
  modified_base (217)..(217): a, c, t, g, unknown or other
  modified_base (226)..(226): a, c, t, g, unknown or other
  modified_base (378)..(378): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatccctccctgtctgcatctgtgganacagatcacntctctgccggngagtcagtnattaacagttattagctggtatcagacaaaacaggacaagttcctagaactcctagatctatgacactactacctactttgactaatcccgtacggggtccacgtcgttcggttcgttcggcgtaggtgggtcgtggactagttactttacncctcaaccgtatacgacgacgacgtccctagtaccacggtaccgtaggaaacgtagttagttacgtaacttaaacctttagtttacgtagttactaaacttaaacttagttaggaattacgtaccgttaccctccccgtacgtaaacccgtacgggttacccgggaacccggaaacggtaaccgtaacggtaaccgtaaacgtaaaacgtaaccgaaaacggtacgttaacggtcgtaccg

SEQ ID NO: 360732 - DNA, 560 bp, Homo sapiens
  misc_feature: GZ8MTXP02JJRS2.52.59.F04.1.454.CMB.2.raw
  modified_base (227)..(227): a, c, t, g, unknown or other
  modified_base (276)..(276): a, c, t, g, unknown or other
  modified_base (287)..(287): a, c, t, g, unknown or other
  modified_base (297)..(297): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtcctccactcctccctgtctgcatctgttggagacagacgtcaccattctcgttggccgggngagtcgaggtctaattaactagttattagcctggtatcagacaaaacgnggacaagttcngactctgatntatcgacacatcctattgacaacgtccgacgggtcccattcgttcggttcgtgcgtaggtgggtcgtaggactagttactttctacctactactactcacgactacgtcctagccgttacgaccgtaggtaaagtagttcgttacgactttaactttattctgtactaataactatgaactgaactccgtacctcgaacgtacgtccggaacgaacggactaacgaagtaaacggaaactacggaaaccgaagtcggacgtcg

SEQ ID NO: 360733 - DNA, 601 bp, Homo sapiens
  misc_feature: GZ8MTXP02HC8HN.52.59.F04.1.454.CMB.2.raw
  modified_base (222)..(222): a, c, t, g, unknown or other
  modified_base (268)..(268): a, c, t, g, unknown or other
  modified_base (393)..(393): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttggccgggnagtcaggtcattaacagttattagcctggtatcagaacaaaaacgnggactaagttcctagaactctagatctatgacactactcctaatttcgactaagtcccgtaacggggtcccctagtcgttcggttcgttggctagggtgggtcgtggggaactagtacttttacnctacaaccatcagctagccctgcagcctagaaagtgttgtactactaactttattctagtactaataaacttatagtattcgaactcccgtaccccttacgaaaccgtacccgggttaccggaaccgaaaacggggtaaccctaaaaggaacgttaaacgggtaaaaaactaccggaaaaaaaccgtcggttaccggttaggtacccg

SEQ ID NO: 360734 - DNA, 561 bp, Homo sapiens
  misc_feature: GZ8MTXP02JAJJU.52.59.F04.1.454.CMB.2.raw
  modified_base (195)..(195): a, c, t, g, unknown or other
  modified_base (219)..(219): a, c, t, g, unknown or other
  modified_base (265)..(265): a, c, t, g, unknown or other
  modified_base (294)..(294): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgtgganacagagtcaccatctctggccggngagtcaggtcaattaacagttattagctggtatcagaacaaaacgnggactaacgttccagactctgtactctangacactactcctatttgactaatcccgacgggtcccagttcgtcggtttcgtcggcgtagggttcgggtcgtgggactagttactttacctctactaccatcagacacgtcctgcacgtaccgtagtaagtgtacggttctacgttaactttgttacttagtactaattaactagtagtatgtactacctccccgtactacgtaccgttacggaccgtaaacggactaacggaagtaacggaactaacgaaacgtcgtagtcggtac

SEQ ID NO: 360735 - DNA, 646 bp, Homo sapiens
  misc_feature: GZ8MTXP02JW65M.52.59.F04.1.454.CMB.2.raw
  modified_base (218)..(218): a, c, t, g, unknown or other
  modified_base (222)..(222): a, c, t, g, unknown or other
  modified_base (231)..(231): a, c, t, g, unknown or other
  modified_base (256)..(256): a, c, t, g, unknown or other
  modified_base (267)..(267): a, c, t, g, unknown or other
tcagcgcagtacgacacgaccggtgctcgatttagtacacacacttagggattggggagtctctctcagccaggacacagcatggacatggagggtccctgctcagctcctgggactcctgctgctctggctcccagataccagatgtgacatccagatgacccagtctccatcctccctgtctgcatctgttggagacagagtcacatctctgcggnagtnagtcatacngttattgctgtatcagacaaaacgnggactagtccngaactcctagatctatgacactactccgtactttgactaagtcccgtacggggtccacgttcgttcgggttcgttgggcctagggtcgggttcgtaggggtaactaggttacttttaaccctctacccgtaacctacttacgacgccgttaacgcccttaggacccgtacggtccccttaaggtaaaacggttgttacgtttacgggtaacctttaaaacgttttctttttaccggtagttaacccgtaatttaaaccgtattagtaacgtttagaacttccccgtacccgtactaccggtacggttaccgggaacgtaaccggggtacaacggtgtaaacggtaaacttaacgaaacgtaccgttaggcggttaaccc

SEQ ID NO: 360736 - DNA, 538 bp, Homo sapiens
  misc_feature: GZ8MTXP02JE0AD.52.59.F04.1.454.CMB.2.raw
  modified_base (195)..(195): a, c, t, g, unknown or other
  modified_base (221)..(221): a, c, t, g, unknown or other
  modified_base (266)..(266): a, c, t, g, unknown or other
  modified_base (451)..(451): a, c, t, g, unknown or other
  modified_base (465)..(465): a, c, t, g, unknown or other
  modified_base (479)..(479): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgttgganacagagtcaccatctcttggccgggnagtcaggtcattaacagttattagcctggtatcagacaaaaaccngggacaaggttctagaactcctgatctatgacacactcctactttgactatccgacggggtccctagtcttcggttcgttcggcgtaggtcggggtcgtacggggactacgtattttacctctaccacatcagcagcctgcacgcctagaacgtattagttcgtactaaccgtttatttaccgtntcctaatactatgntagactcgccctanaccgtcgtacgaccgaacggaccaacgcgtaacgaaacacgaaacgtcgttagcgtacg

SEQ ID NO: 360737 - DNA, 663 bp, Homo sapiens
  misc_feature: GZ8MTXP02FJKK0.52.59.F04.1.454.CMB.2.raw
  modified_base (222)..(222): a, c, t, g, unknown or other
  modified_base (254)..(254): a, c, t, g, unknown or other
  modified_base (265)..(265): a, c, t, g, unknown or other
  modified_base (283)..(283): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatccctccctgtctgcatctgttggagacagagtcaccatctcgtgccgggngagtcaggtcattacagttattagctggtatnagacaaaacgnggacagttctgaactccngtatcatcgacacatccctacttgactaagtcccgacggggtccctagtccgttcggtttcggttaggcgtaggtgggtcgtggtactagtattttcctactccgacagtacacggacacgcccgtcgacgacgtacccgttagggaaaagtcgtttacggttacggtaccttaaaaccgtttttaacgttctttacggttaacccttaaacgttaaaacgttttatacggtaatttacgggtaacccttaaccggtccccccttaaacgtacccggtacccggtttaaccgggacccggaaaaccggggtaccctaaaacgggaacgttaaacggaaaacgttaaccggaaaaccctaaaggttcggacggttaacccg

SEQ ID NO: 360738 - DNA, 696 bp, Homo sapiens
  misc_feature: GZ8MTXP02GAXAC.52.59.F04.1.454.CMB.2.raw
  modified_base (219)..(219): a, c, t, g, unknown or other
  modified_base (261)..(261): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctccctgtctgcatctgttggagacagagtcacatctctggccggngagtcagtcattacagttattagctggtatcagacaaaacgnggacaagttcctagtaacctctgactctatcgacactacttacctactttcgactaacgtcccgtacggggtccctacgttccgttccggtttcggttgggtccgtagggttcggggtcgtacggggtactaggtttaacttttacgtacctacctaacccgtactacgaacgtacgtaccgtcccgttagacccgacgggtacccgttaaggtaaaacggttcgttacggtttacggtaacctttaaacttttaacggtttttacttaaccggtttaacctaaagtttaaaccttaagttacggttaatacggtacttacccggtacccccttacgtaaccgttaacccgggttacgggaacccgtaaacggggaaccctaaagccgttaaaacggtaaaactaaccgtaaaacgtaccgtaggtacgtaaccg

SEQ ID NO: 360739 - DNA, 607 bp, Homo sapiens
  misc_feature: GZ8MTXP02IAVWQ.52.59.F04.1.454.CMB.2.raw
  modified_base (198)..(198): a, c, t, g, unknown or other
  modified_base (203)..(203): a, c, t, g, unknown or other
  modified_base (219)..(219): a, c, t, g, unknown or other
  modified_base (398)..(398): a, c, t, g, unknown or other
  modified_base (407)..(407): a, c, t, g, unknown or other
tcagcgcagtacgacacgaccggtgctcgatttagtacacacacttagggattgggggagtctctctcagccaggacacagcatggacatgagggtccctgctcagctcctgggacctcctgctgctctggctcccagataccagatgtgacatccagatgacccagtctccatccctcctgtctgcatctgttgganacagntcacatctctggcggnagtcaggtcattaacagttattagctggtatacagaacaaaacgaggactaagttcctagacctcctgatctatcgaacactactcctatttacgactaagtcccgaaccggggttccctattccggttcggtttcggttcggcgtagggttgggtccgtagggactagttacttttcnccttcactntcagcacgtctgacacgtcctagaaacgtgttagtcgtaacttacttttactttctacgttaactaattaaagtagttaatacgtacgtacctacccgtacccttacgaaccgttaccggtaccggaaaccggtaaccggaaccgtaacgtaacggtaaaacgtaaaccgtaaacgtaaacgtacggtacggtacgtacg

SEQ ID NO: 360740 - DNA, 653 bp, Homo sapiens
  misc_feature: GZ8MTXP02I8J28.52.59.F04.1.454.CMB.2.raw
  modified_base (187)..(187): a, c, t, g, unknown or other
  modified_base (200)..(200): a, c, t, g, unknown or other
  modified_base (203)..(203): a, c, t, g, unknown or other
  modified_base (226)..(226): a, c, t, g, unknown or other
  modified_base (275)..(275): a, c, t, g, unknown or other
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatcgacccagtcctccatccctcctgtccngcatctgttgganacngagtcacatctcgttcggccggngagtcagtactaattaatagttattgctgtactcaagaacgaaaaccgnggtacctaaggtttccagtaacctccgtgtatactatacgactactacgtacctactttcgactaacgtcccggtaccgggtaccctagtttcccggttacggtttccggtcgggtcgtacgggtcggggtacgtacggggtacttaaggtttactttactacctacctactacgtcgaagtccgacgtccctaggtacctacggtacccgtagtaaacgttcgttacggtacttacgtttaacttttacgttaccttgtaacctaaagttactaggtacaggtacaccgtccctacccttacgtaccggtacgtacccggaccgtaaacggaaccgacgtaaccgtaaacgtaacaacgtacgtacgtaggactacg

SEQ ID NO: 360741 - DNA, 630 bp, Homo sapiens
  misc_feature: GZ8MTXP02H41O1.52.59.F04.1.454.CMB.2.raw
  modified_base (230)..(231): a, c, t, g, unknown or other
  modified_base (431)..(431): a, c, t, g, unknown or other
  modified_base (622)..(622): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatcgaccccagttcctccactccctcctgtctgctattctggtggagacagagtcacatctcgttcggccgggnngtcaggtctaattaactagttattacgctaggtactacacgaaccaaaaccgaggactaacgttcctagtaacctctagtactctatgaactactactacctactttacgactaactcccggtacggggtaccctagtccggttcggttacggttcgggacgttgggttcgggtcgtacgggtactagttacttttaccncctacactatcgaactcgacgtcgtgacccgagtaccgtagaaacgttgttacgggttacttactttaacgtttattccgttatactaactttaaactgtatagtcgtaacgtccgtaccctgtaaccgtcgggttaaccgaccggaaacggaccaagtaaccgtaagaaaccttacgaaaccgtacggtntaacggcg

SEQ ID NO: 360742 - DNA, 634 bp, Homo sapiens
  misc_feature: GZ8MTXP02FZ1Q9.52.59.F04.1.454.CMB.2.raw
  modified_base (197)..(197): a, c, t, g, unknown or other
  modified_base (221)..(221): a, c, t, g, unknown or other
  modified_base (262)..(262): a, c, t, g, unknown or other
  modified_base (283)..(283): a, c, t, g, unknown or other
tcagcgcagtacgacacgaccggtgctcgatttagtacacacacttagggattgggggagtctctctcagccaggacacagcatggacatgagggtccctgctcagctcctgggactcctgctgctctggctcccagataccagatgtgacatccagatgacccagtctccatcctccctgtctgcatctgttgganacagatcaccatctctggccgggnagtcagtcattaacagttattagctggtatcagacaaaacngggacaagttcctgaactccngtatctatgacacatccatttgactataccgacggggtcccctagtccgtcggtttcgttcgggccgtagggtcggggtacgtagggtaccgtaggttacttttacctctaccctaacccattacgaacgctacgtcctcgactcgtacccgtaggaaagtagttacggttacgacttaaaccgttttacttttcctacggttaccaaattaccgttaatcgttaaagtcgtaaacttccggaccccctacgtaccgtaacggtttcccgggaaacccgtaaacgggggacccttaaaggcgtaaaacggtaaaacgttacgaaaaaccggtttacacgggttcggaaccg

SEQ ID NO: 360743 - DNA, 705 bp, Homo sapiens
  misc_feature: GZ8MTXP02IBSMY.52.59.F04.1.454.CMB.2.raw
  modified_base (409)..(409): a, c, t, g, unknown or other
tcagcgcagtacgacacgaccggtgctcgatttagtacacacacttagggattggggagtctctctcagccaggacacagcatggacatgagggtccctgctcagctcctgggactcctgctgctctggctcccagataccagatgtgacatccagatgacccagtctccatcctcctgtctgcatctgtggagacagatcactatctcgttcggccgggcgtagtcaggtcattaacagttattagcctggtatacaagtacaaaaaccgagggcaacgttacctagactccagtatctaatgaacactactcgtactttgactaacgcccgacggggtccctatccgttcggttccgttggccgtggttcggggtcgtagggacgtagtaattttacccgtccttanacccctagtactaacgcgaaccgtccgttaacgcaacggtacccgttaggaaaccgttaacggtttgggttacgtaaccgtttaaaccgttttaacttttaccgttaaggttaaccttaaaaccggttaacttaacgtttaaaggtagtttacgtaccgtttaacccggtcccccttaaccgtaaacccgtacccgggggtttaccggtaaccccggaaaacgggggaacccctaaaggtaaccgttaacgggaaaacttaaccgtaaaaaccgggaacgttaacggtcggtaacc

SEQ ID NO: 360744 - DNA, 514 bp, Homo sapiens
  misc_feature: GZ8MTXP01DU5W9.21.4.A04.1.454.CMB.2.raw
  modified_base (201)..(201): a, c, t, g, unknown or other
  modified_base (292)..(292): a, c, t, g, unknown or other
  modified_base (369)..(369): a, c, t, g, unknown or other
  modified_base (403)..(403): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggcctcccaggttcctnatctatgctgggtcccagagggccactggcatcccagacaggttcagtggcaggtgggctgggacagacttcactcncatcattagcagactggagcctagaagtattcgntagtgtattactgtcagctagtatggaagttctactcgtgtcgttcggaccgttaaagggaccttaaagggtagaaaattggaaaacgactggtgctgcacctaagttctg

SEQ ID NO: 360745 - DNA, 550 bp, Homo sapiens
  misc_feature: GZ8MTXP01CZSAQ.21.4.A04.1.454.CMB.2.raw
  modified_base (215)..(215): a, c, t, g, unknown or other
  modified_base (262)..(262): a, c, t, g, unknown or other
  modified_base (301)..(301): a, c, t, g, unknown or other
  modified_base (384)..(384): a, c, t, g, unknown or other
  modified_base (389)..(389): a, c, t, g, unknown or other
  modified_base (483)..(483): a, c, t, g, unknown or other
  modified_base (542)..(542): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttgggtccagcctggagggtccctgagactctcctgtgcagcctntgcatcaccttcagtgaccacaacatggactggggtccnccaggctccgaggggaaggggctgggagtgggcgccgtattacaaggaaagctaacagttacaagtaacaagaaatacgggcncgtcngtagaaaaggaggttcaaccatctacaaagagatgaattacaaaagaactacactggtaatctagacaaaatgaaacagacctagaaaacccgngacacggcctgttattagttgtaggtagaacgaaaagagtggaatggtaggtggttagngttgtaag

SEQ ID NO: 360746 - DNA, 605 bp, Homo sapiens
  misc_feature: GZ8MTXP01DK7MI.21.4.A04.1.454.CMB.2.raw
  modified_base (251)..(251): a, c, t, g, unknown or other
  modified_base (257)..(257): a, c, t, g, unknown or other
  modified_base (259)..(259): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggtatttacaagtgtcagtgtgaggtgcagctggtggagtctgggggagacttggtccagcctggagggtccctgagactctcctgtgcngctctncntctactcagtagacacaacagtaggacgtcggtccgccgacggcgtacgaggggagggggacggtgggtagggtcgggtcggtaccggtacgtaacgaaacggaaagtacgtaacgtaacgtaacgtaaacgtaacgaagaaacgtacggacgcgtcgtaggtaggaaagggtaagtacgtacactactacgaagaagtatagtataacgtaaacgtaactactactacgtactacgtacgactaaataacgaacgacgacgtaacgaaacgaacggacgacggtaacgtagttattagttagtagtaagaagaagagtaaggtagtggtggtggttagtgttgtg

SEQ ID NO: 360747 - DNA, 524 bp, Homo sapiens
  misc_feature: GZ8MTXP01BVAFW.21.4.A04.1.454.CMB.2.raw
  modified_base (263)..(263): a, c, t, g, unknown or other
  modified_base (275)..(275): a, c, t, g, unknown or other
  modified_base (284)..(284): a, c, t, g, unknown or other
  modified_base (288)..(288): a, c, t, g, unknown or other
  modified_base (300)..(300): a, c, t, g, unknown or other
  modified_base (342)..(342): a, c, t, g, unknown or other
  modified_base (487)..(487): a, c, t, g, unknown or other
  modified_base (496)..(496): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctntgcatcaccttnagtgaccanaacntggactgggccncaggctcgagggagggctggagtggcgcgtatacgaaggaanctaacagtacaagtacaagaatacgggcgcgtctgtagaaaaggagttcaaccgatctacaaagagatgatacaaagactcactggtatctagacaaatgaaacagacctagaaaccgagacacggctgttattattgtaggtanaacgaaagngtggatggtggtcgttagcgttgtaacg

SEQ ID NO: 360748 - DNA, 563 bp, Homo sapiens
  misc_feature: GZ8MTXP01DCRZK.21.4.A04.1.454.CMB.2.raw
  modified_base (211)..(211): a, c, t, g, unknown or other
  modified_base (251)..(251): a, c, t, g, unknown or other
  modified_base (253)..(253): a, c, t, g, unknown or other
  modified_base (255)..(255): a, c, t, g, unknown or other
  modified_base (259)..(260): a, c, t, g, unknown or other
  modified_base (262)..(262): a, c, t, g, unknown or other
  modified_base (269)..(270): a, c, t, g, unknown or other
  modified_base (277)..(277): a, c, t, g, unknown or other
  modified_base (280)..(280): a, c, t, g, unknown or other
  modified_base (305)..(305): a, c, t, g, unknown or other
  modified_base (310)..(310): a, c, t, g, unknown or other
  modified_base (455)..(455): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggttattacaagtgtcagtgtgaggtgcagctggtggagtcgtggggganacttggtccagccgtggagggtccctgagactctcctgtncncnctcnncntctctcnncacacanagngcgtcggcgcgcgcgcgagggaggngtggnggtggtcggtcgtagtaacgaaacgaagactaacgtagtacgtaaagtaacgaagaacgtacggcgtcgtcgtagtagaaaggtaacgtacactactactagaagaagatataataactaaacgtaactactactagtatactanaacgtaaagtaagaacgaacgacgtaacgtaaacggaacgacgacgtaacgtagttagttagttagtagtaagaagaagagtaagtagtggtggtggttagtgttgtg

SEQ ID NO: 360749 - DNA, 496 bp, Homo sapiens
  misc_feature: GZ8MTXP01AZQM5.21.4.A04.1.454.CMB.2.raw
  modified_base (201)..(201): a, c, t, g, unknown or other
  modified_base (211)..(211): a, c, t, g, unknown or other
  modified_base (293)..(293): a, c, t, g, unknown or other
  modified_base (312)..(312): a, c, t, g, unknown or other
  modified_base (401)..(401): a, c, t, g, unknown or other
tcagtcgtcgctcgcacgaccggtgctcgatttagagtagtgatcaggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctntcctgcagctccagccagaatatccagagctaactacatagcctggtaccagcagaagcctggccaggctcccaggttcctnatctatgctgggtccccanagggccactggcatcccagacaggttcagtgcagtgggtctgggacagacttcactctcatcattagcagactggagctgaagattcgnagtgtattactgtcagcagtatggaacgttcacctctgtcgttcggcttaagggaccaagggtagaaattgaaacgactgtgctgcacaattctg

SEQ ID NO: 360750 - DNA, 508 bp, Homo sapiens
  misc_feature: GZ8MTXP01A2LTV.21.4.A04.1.454.CMB.2.raw
  modified_base (200)..(200): a, c, t, g, unknown or other
  modified_base (291)..(291): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttccnatctatgctgggtccccagagggcccactggcatcccagacaggttcagtggcaggtgggtctggggacaggtacttcactctcatcattagcagactggacgcctagaagtatttcgctagttgtattactgtcagcagtatggtaagttctactctgtcgttcggcaagggaccaaggtacgaagttagaacgacgtgtggctgcacctgttctg

SEQ ID NO: 360751 - DNA, 532 bp, Homo sapiens
  misc_feature: GZ8MTXP01A2SMD.21.4.A04.1.454.CMB.2.raw
  modified_base (215)..(215): a, c, t, g, unknown or other
  modified_base (283)..(283): a, c, t, g, unknown or other
  modified_base (301)..(301): a, c, t, g, unknown or other
  modified_base (467)..(467): a, c, t, g, unknown or other
  modified_base (502)..(502): a, c, t, g, unknown or other
  modified_base (523)..(523): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacttgggtccagcctggagggtccctgagactctcctgtgcagcctctgcatcaccttcagtgaccanaacatggactggggtccncaggctcgaggggagggctggagtgggtcgcgtatacaaggaagctaacagttacaagtacaagaatacgggcgcgtctggtagaaaaggacgttcaccgatctacaagagatgattacaaagactcactggtaatctagacaaatgaacagacctagaaaaccgngacacggctgttattattgaggtaagacgaaaagngtggatggtgggtggttacgngttggtaag

SEQ ID NO: 360752 - DNA, 534 bp, Homo sapiens
  misc_feature: GZ8MTXP01ECTNT.21.4.A04.1.454.CMB.2.raw
  modified_base (278)..(278): a, c, t, g, unknown or other
  modified_base (301)..(301): a, c, t, g, unknown or other
  modified_base (495)..(495): a, c, t, g, unknown or other
  modified_base (503)..(503): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatccacttcagtnaccacaacatggactggggtccnccaggctcgaggggagggctggagtggtcgcgtatacgaaggaagctaacagttacaagtacaagaaatacggcgcgtctggtagaaaggagttcacatctacaagagatgattacaaagactacactggtatctagacaaatgaaacagaccctagaaaacccgagaccacggctagttattattgtaggtanaagaaagngtaaggatggtggtggttagtcgttgtaacg

SEQ ID NO: 360753 - DNA, 611 bp, Homo sapiens
  misc_feature: GZ8MTXP01D3F86.21.4.A04.1.454.CMB.2.raw
  modified_base (197)..(197): a, c, t, g, unknown or other
  modified_base (283)..(283): a, c, t, g, unknown or other
  modified_base (289)..(289): a, c, t, g, unknown or other
  modified_base (301)..(301): a, c, t, g, unknown or other
tcagtcgtcgctcgcacgaccggtgctcgatttagagtagtgatcagggggaagagctgctcagttaggacccagagggaaccatggaaacccagcgcagcttctcttcctcctgctactctggctcccaggctcagaaaccacggagaaattgtgttgacgcagtctccaggcacctgtctttgctccaggggaangccacctctcctgcagcctccagccagaatatccagagctaacacatagcctggaccagcagaagctgccaggcctccaggttccnatctangctcggcccagnggccagtggcactccagactaggttcagtggcaggtgggtctggggacagtacttcactctcatcattagcagacgtggacgtcgtagaagtattcgactagttgttaattacgtgtacgagtacgtaagttacgttaggtaaacgtttcctaaccgtttcgttcggttcccggttaaccgggaaccggttaaaacgggggtaaacccgttaaaggggttaaaggtaaaacgttaacgggaaaaccggttaacggttaagggttacgggtaaccttacggtaccttaacccgtaacgtttccgtttaacg

SEQ ID NO: 360754 - DNA, 503 bp, Homo sapiens
  misc_feature: GZ8MTXP01AP8Y1.21.4.A04.1.454.CMB.2.raw
  modified_base (201)..(201): a, c, t, g, unknown or other
  modified_base (210)..(210): a, c, t, g, unknown or other
  modified_base (290)..(290): a, c, t, g, unknown or other
  modified_base (356)..(356): a, c, t, g, unknown or other
  modified_base (497)..(497): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctntcctgcagctccagccagaatatccagagctactacatagcctggtaccagcagagcctggccaggctcccaggttcctnatctatgctgggtccccagagggcccatggcatcccagcaggttcagtggcagtgggtctgggacngacttcactctcatcattagcagactggagcctagaagtatttcgctagttgtattacgtgtccagcagtatggtaattcaccttcgtgtcgttcggacttaagggaccaggtagaattagaaacgactggtgctgcactnttcgtg

SEQ ID NO: 360755 - DNA, 587 bp, Homo sapiens
  misc_feature: GZ8MTXP01DW9JW.21.4.A04.1.454.CMB.2.raw
  modified_base (202)..(202): a, c, t, g, unknown or other
  modified_base (211)..(211): a, c, t, g, unknown or other
  modified_base (233)..(233): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatntccagagcttactacatagcctggaccagcagacgcctggccaggcctcccgaggttcctcatctatgctgggtaccccacgagggcccagtcggctactccccaagacctaggttcaggtcggctaggttcggggtctgggggaccaggtaaccttcgaacgttctacgattcatttaggctagacttgggaacgccttagaagtattcgctaagtgttattactgtacagctagtagtggtaacgttctaccttgtgttcggttcggaccgaaaggggtaaccttaaagggtaacgtaaaacgttaggaaaacgttacgtgggtggtctagaccttacgtaattcgttaacg

SEQ ID NO: 360756 - DNA, 591 bp, Homo sapiens
  misc_feature: GZ8MTXP01CH3U2.21.4.A04.1.454.CMB.2.raw
  modified_base (212)..(212): a, c, t, g, unknown or other
  modified_base (298)..(298): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcttgttgttatttacaaggtgtcagtgtgaggtgcagctggtggagtcgtggggganacttggtccagcctggaggtccctgagactctcctgtgcagcctctgcatcaccttcagtcgaccacaacagtggactcgggtccnccaggcctccgagggggaagggcgtgggaggtgggtcggaccgtagttaacgaaaggaaagctaaacagttaaccaaaggtaacaagaaatacgggcgcgtctaggtagaaaggtagttcaacaatctacaaagagatgaacttacaaaagtaactcaacttgggtaacttcgaagaactaaataagaacgaacgaacgtaacgaaaccggaacggaacgacggtaacgtagttagttagttagtagtaagaagaaagaaggtaaggtagtggtgggtaggttagtcgttgtg

SEQ ID NO: 360757 - DNA, 533 bp, Homo sapiens
  misc_feature: GZ8MTXP01D1822.21.4.A04.1.454.CMB.2.raw
  modified_base (300)..(300): a, c, t, g, unknown or other
  modified_base (345)..(345): a, c, t, g, unknown or other
  modified_base (380)..(380): a, c, t, g, unknown or other
  modified_base (403)..(403): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtgaccacaacatggactgggtccncaggctcgaggggaggctggagtgggtcgcgtatacgaaggaaanctaaacagttacaagtacaagaatacggcgcgtcnggtagaaaggagttcaccatcanaaagagatgaacttcaaaagactcattggtaatctagacaaataagaacgacgacaacgaaacgaacgacgacgaacgtagttatagttgtagtagaagaaagagaagagtggtggtggttagtgttgtg

SEQ ID NO: 360758 - DNA, 536 bp, Homo sapiens
  misc_feature: GZ8MTXP01DUVWP.21.4.A04.1.454.CMB.2.raw
  modified_base (301)..(301): a, c, t, g, unknown or other
  modified_base (343)..(343): a, c, t, g, unknown or other
  modified_base (373)..(373): a, c, t, g, unknown or other
  modified_base (458)..(458): a, c, t, g, unknown or other
  modified_base (473)..(473): a, c, t, g, unknown or other
  modified_base (502)..(502): a, c, t, g, unknown or other
  modified_base (511)..(511): a, c, t, g, unknown or other
  modified_base (523)..(523): a, c, t, g, unknown or other
  modified_base (528)..(528): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtcgaccacaacatggactgggtccncaggctcgagggagggctggagtggtcgcgtatacaaggaanctaacagttacaagtacaagaatacgggcncgtctaggtagaaaggtaggttcaccatctacaaagagtatagaattacaaaagacttacactggtaatctagacaaatgaaacngacctagaaaaccgnggacacggctgttattagttgacggtaanaacgaaagngtggatggtggngttancgttggtc

SEQ ID NO: 360759 - DNA, 575 bp, Homo sapiens
  misc_feature: GZ8MTXP01BBOOV.21.4.A04.1.454.CMB.2.raw
  modified_base (263)..(263): a, c, t, g, unknown or other
  modified_base (302)..(302): a, c, t, g, unknown or other
  modified_base (346)..(346): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctntgcatcaccttcagtcgaccacaacatggactgggtccncaggctccgagggagggctggagtgggcgcgtatacgaaggaanctaaacagttacaagtacaagaatacgggcgcgtctaggtagaaaaggtagttcaaccatactacaaagagatagattacaaaagtactcaacttggtaatctagaactaaagtcgaaacagaacccctaaggaaaacccggaggaaccgacggtccgtagttattagttggtaggtaagaacgaaaaggaggttgggaattgggtgggtcggttagtcgttggtaacg

SEQ ID NO: 360760 - DNA, 559 bp, Homo sapiens
  misc_feature: GZ8MTXP01DQUJQ.21.4.A04.1.454.CMB.2.raw
  modified_base (283)..(283): a, c, t, g, unknown or other
  modified_base (302)..(302): a, c, t, g, unknown or other
  modified_base (352)..(352): a, c, t, g, unknown or other
  modified_base (377)..(377): a, c, t, g, unknown or other
  modified_base (442)..(442): a, c, t, g, unknown or other
  modified_base (459)..(459): a, c, t, g, unknown or other
  modified_base (477)..(477): a, c, t, g, unknown or other
  modified_base (510)..(510): a, c, t, g, unknown or other
  modified_base (522)..(522): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtgaccanaacatggactggggtcccncaggctcgaggggagggctggagtgggtcgcgtatacgaaggaagctaanagttacaagtacaagaatacgggcngtctggtagaaaggagttcacctatctacaagagatgaattacaaaagactacacttggtaactntagacaaaatcgaaacngaccctaagaaaacccgnggacacgggcttgttatttagttggtaggtaanaaacgaaaaggngttaagggatggtgggtggttagtcgttaaggtaacg

SEQ ID NO: 360761 - DNA, 537 bp, Homo sapiens
  misc_feature: GZ8MTXP01EY2BA.21.4.A04.1.454.CMB.2.raw
  modified_base (216)..(216): a, c, t, g, unknown or other
  modified_base (360)..(360): a, c, t, g, unknown or other
  modified_base (502)..(502): a, c, t, g, unknown or other
  modified_base (508)..(508): a, c, t, g, unknown or other
  modified_base (515)..(515): a, c, t, g, unknown or other
tcagtcgtcgctcgcacgaccggtgctcgatttagagtagtgatcaggggagctctgagagcggggccccagccccagaattcccaggtgttttcatttggtgatcagcactgaacacagaggactcaccgatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtgaccacaacatggactgggtcccgccaggctccgagggaagggctgggagtgggtcgccgtatacgaaggaaacgctaaacngtacagtaacagaatacgggcgcgtctagtaggaaagggaagttcaccgatctcaaagagatgaattacaaagactcaactgtaatctgacaaatgaacagcctagaaacccgagacacggctgtattagtgttgtagtaanaaaggngttaggntggtggtggtagcgtgttgaac

SEQ ID NO: 360762 - DNA, 551 bp, Homo sapiens
  misc_feature: GZ8MTXP01DNBDM.21.4.A04.1.454.CMB.2.raw
  modified_base (300)..(300): a, c, t, g, unknown or other
  modified_base (474)..(474): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctctgcatcaccttcagtgaccacaacatggactggggtccnccaggctccgaggggaagggctgggagtggtcggcgtatacgaaggaagctaacagttacaagtacaagaaatacgggcgcgtctgtagaaaggtagttcaccatctacaaagagatgattacaaaagactcacttggtaatctagacaaatgaacagacctaagaaaacccgnggaccacggtcgtgttattagttgtaggtagaacgaaaaggagtgggaagtgggtgggtggttagtcgttggtaacg

SEQ ID NO: 360763 - DNA, 545 bp, Homo sapiens
  misc_feature: GZ8MTXP01CKMBU.21.4.A04.1.454.CMB.2.raw
  modified_base (300)..(300): a, c, t, g, unknown or other
  modified_base (349)..(349): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctctgcatcaccttcagtgaccacaacatggactggggtccnccaggctccgaggggagggctggaggtgggtcgccgtatacgaaggaanctaacagttacaagtacaagaatacgggcgcgtcagtagaaaggtaggttacacctatctacaagagatgattacaaagactcactgtatctgacaaatgaacagacctaaggaaacccgaggaccgacggccgtagttattagttgtaggtagaacgaaagaggtaaggattggtggtcggagtcgttggtaacg

SEQ ID NO: 360764 - DNA, 568 bp, Homo sapiens
  misc_feature: GZ8MTXP01BCA8X.21.4.A04.1.454.CMB.2.raw
  modified_base (255)..(255): a, c, t, g, unknown or other
  modified_base (262)..(262): a, c, t, g, unknown or other
  modified_base (300)..(300): a, c, t, g, unknown or other
  modified_base (346)..(346): a, c, t, g, unknown or other
  modified_base (434)..(434): a, c, t, g, unknown or other
  modified_base (527)..(527): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacttggtccagcctggagggtccctgagactctcctgtncagcctntgcatcaccttcagtgaccacaacatggactgggtccncaggctcgaggggagggctggagtgggtcgcgtatacgaaggaacnctaacgagttacaagtacaagaatacgggcgcgtctaggtacgaaaggtagttacaccatctacaaagagtatgattacaaaagactnaactggtaactcgtagacaaatcgaaacagtaccctaaggaaaaacccggtggaaccaacgggtccgttagttaatttagttggtagggtaanaaacgaaaggttgtggatggtgggtgttagtcttggtaacg

SEQ ID NO: 360765 - DNA, 555 bp, Homo sapiens
  misc_feature: GZ8MTXP01BUQ26.21.4.A04.1.454.CMB.2.raw
  modified_base (216)..(216): a, c, t, g, unknown or other
  modified_base (303)..(303): a, c, t, g, unknown or other
  modified_base (354)..(354): a, c, t, g, unknown or other
  modified_base (380)..(380): a, c, t, g, unknown or other
  modified_base (432)..(432): a, c, t, g, unknown or other
  modified_base (521)..(521): a, c, t, g, unknown or other
tcagtcgtcgctcgcacgaccggtgctcgatttagagtagtgatcagggggagctctgagagcggagccccagccccagaattcccaggtgtttcatttggtgatcagcactgaacacagaggactcaccatggagtttgggctgagctgggttttccttgttgttatttacaaggtgtccagtgtgaggtgcagctgggtggagtcgtggggganacttgggtccagcctgggagggtccctgagactctcctgtgcagcctctgcatcaccttcagtcgaccacaacatggactggggccncaggctacgaggggagggctggagtgggcgcgtatacgaaggaagctaacngtaacaagtaacaagaaatacgggcncgtactgtaggaaagagttcacatctacaagagatagattacaaaagactanactggtaatctagacaaatgaaaccagaaccctaaggaaaacccgaggaaccacgggtctagttattagttggtagtaagaagaaaagngtaaggagtggtgggtggttacgtgttggtaacg

SEQ ID NO: 360766 - DNA, 608 bp, Homo sapiens
  misc_feature: GZ8MTXP01CB9QU.21.4.A04.1.454.CMB.2.raw
  modified_base (211)..(211): a, c, t, g, unknown or other
  modified_base (296)..(296): a, c, t, g, unknown or other
  modified_base (343)..(343): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgttgttatttacaaggtgtcagtgtgaggtgcagctggtggagtcgtggggganacttggtccagcctggagggtccctgagactctcctgtgcagcctctgcatcaccttcagtgaccacaacatggactggggtccncaggctcgaggggagggctggagtgggtcgcgtatacgaaaggaagntaacagttacaagtaacaagaatacgggcgacgtctaggtaggaaaaggtaggttacaacctagtaccgtaagaaaggagtagtagtaactaaacgaaaagtaaactactacttacggttactacgtacgtaacgtaaataacgaacgaacgaaccgaacgtaaaccgaaacggaaccgaccggtaacgtagttagttaagttagtaggtaagaaacgaaaggttaaggtaaggtaggtaaggtgggtaggttagtcgttgtaag

SEQ ID NO: 360767 - DNA, 754 bp, Homo sapiens
  misc_feature: GZ8MTXP01AGG2R.21.4.A04.1.454.CMB.2.raw
  modified_base (202)..(202): a, c, t, g, unknown or other
  modified_base (293)..(293): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagagcctggccaggcctcccaggttcctnatctatgctcgggtccccacgaggggcccacgtcggccaacgtcccccgaaggaccgtacgggtttccaaggttcggggaccgtaggggttcgggggttccctgggggaacctagggtaaccttttcccgaaccttcctactaacttacctaatttacggaccgtaacggtaccgttaggggaacggtacccgttaggtaaacggtacgttttaccggaccgttaaggtttaggtttaaacgtttaacgttcggtttacgaacggtacgtaaggttaacgttaggggtaaacgtttccctaacccgtttaccgttacggttcccgggtttaacccgggaacccggttaaacgggggtaaaccccgttaaaggggtaaaggtaaaacgttaacgggttaaaaccggttaaccgttaagggtacgggtcgttacgggaccgttacccgtaagttcccgtttcg

SEQ ID NO: 360768 - DNA, 768 bp, Homo sapiens
  misc_feature: GZ8MTXP01D4P0G.21.4.A04.1.454.CMB.2.raw
  modified_base (202)..(202): a, c, t, g, unknown or other
  modified_base (211)..(211): a, c, t, g, unknown or other
  modified_base (297)..(297): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagacagacgcgtggccaggtcctaccgtacggttccnatctagtcgcgtcgggtacccaggcgggaccctagtcggacctaccgtcccgaagaccgttaggttccagggttcggaccgtaggggttcggggtaccgtaagggggaacctacgggttaacccttcctaccttctactaacttacctaagttacgacgaaggtaccggttagggaaaccgtccgttaaaggtaaacgtttcgtttacccggagttaaagggtttaccgtttaaaggtttaaccttggtttaaccgaaaggttaccgttaaaggtttaggtttaacggggttaaaaccgttttccctaacccgtttggtttccgggtttacccgggttaacccgggaaacccggttaaaggggaaacccgttaaaggggtaaaacgtaaaacggttaaaccgggaaaaccgttaacggttgggtaaccggttctaccggacccgttaaacgttaactttccggtttaaccg

SEQ ID NO: 360769 - DNA, 493 bp, Homo sapiens
  misc_feature: GZ8MTXP01DWYVZ.21.4.A04.1.454.CMB.2.raw
  modified_base (202)..(202): a, c, t, g, unknown or other
  modified_base (240)..(240): a, c, t, g, unknown or other
  modified_base (292)..(292): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccaganctactacatagcctggtaccagcagaatcctggccaggctcccaggttcctnatctatgctgggtcccacgagggccactggcatcccagacaggttcagtgcagtgggctggggacagacttcactctcatcattagcagactggagctgaagattcgcagtgtattactgtcagcagtatggtaagttcactctgtcgttcggcgaagggaccaaggtagaattagaacactgtagctgcactaattcgtg

SEQ ID NO: 360770 - DNA, 547 bp, Homo sapiens
  misc_feature: GZ8MTXP01BENHS.21.4.A04.1.454.CMB.2.raw
  modified_base (215)..(215): a, c, t, g, unknown or other
  modified_base (261)..(261): a, c, t, g, unknown or other
  modified_base (273)..(273): a, c, t, g, unknown or other
  modified_base (300)..(300): a, c, t, g, unknown or other
  modified_base (341)..(341): a, c, t, g, unknown or other
  modified_base (346)..(346): a, c, t, g, unknown or other
  modified_base (358)..(358): a, c, t, g, unknown or other
  modified_base (370)..(370): a, c, t, g, unknown or other
  modified_base (429)..(429): a, c, t, g, unknown or other
  modified_base (470)..(470): a, c, t, g, unknown or other
  modified_base (510)..(510): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctntgcatcaccttnagtgaccacaacatggactggggtccnccaggctcgagggagggctggagtggcgctatacaaggaanctaangttacaagtacngaaatacgggcncgtctagtaggaaaaggtaggttcaaccatctacaagagatgaattacgaaaagactanacttggtatactgactaaatgaaacagacctagaaaaccgnggaccacgggctgttattattgaggtaagaacgaaaaggnggtaaggagtggtggtacgggttagtcgttggtaacg

SEQ ID NO: 360771 - DNA, 596 bp, Homo sapiens
  misc_feature: GZ8MTXP01D6NMX.21.4.A04.1.454.CMB.2.raw
  modified_base (251)..(251): a, c, t, g, unknown or other
  modified_base (325)..(325): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggtatttacaagtgtcagtgtgaggtgcagctggtggagtctgggggagacttggtccagcctggagggtccctgagactctcctgtgcngctctgctatctactcagtacgaccacaacagtggacgtcggtccgccgcggcgtacggaggggagggcgtggnggtggtcggtcgtagtaacgaacggaagacgtaacgtagtacgaaagtacgaagaagtacgacgtcgtcgtagtagaaaggtaacgtacgtacactactacgaagaagtagtagtaataacaaacgtaactactactacgttattacgtacgaactaaagtaacgaaacgaacgaacgtaacgtaaaccggaacggaacgaacggtaacgtacgttagttagttagtaggtaagaagaaagagtaaggtagtggtggtggttagtgttgtg

SEQ ID NO: 360772 - DNA, 531 bp, Homo sapiens
  misc_feature: GZ8MTXP01BX097.21.4.A04.1.454.CMB.2.raw
  modified_base (287)..(287): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaagagccaccctctcctgcagctccagccagaatatccagagctactacatagcctggtaccagcagagcctggccaggctccaggttcctnatctatgctcgggtccccacgaggggcccactggcactccccagacacggttcagtggcaggtgggtctggggacaggtacttcacttctcatcattagcagactggaagcctagaagtattcgcagtgttattactgtcagctagtagtggtaacgttcaccttgtcgtcggttccggacaaagggtaccgaaggtaagaaattacgaaacgaacgtgtggctggaccaccgtaattcgttcg

SEQ ID NO: 360773 - DNA, 491 bp, Homo sapiens
  misc_feature: GZ8MTXP01CB589.21.4.A04.1.454.CMB.2.raw
  modified_base (201)..(201): a, c, t, g, unknown or other
  modified_base (210)..(210): a, c, t, g, unknown or other
  modified_base (291)..(291): a, c, t, g, unknown or other
  modified_base (380)..(380): a, c, t, g, unknown or other
  modified_base (477)..(477): a, c, t, g, unknown or other
  modified_base (489)..(489): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctcccaggttcctnatctatgctgggtcccagagggcccactggcatcccagactaggttcagtggcagtgggtctgggacagtacttcactctcatcattancagactggagctagaagatttcgcagtgttattactgtcagctagtatggaagttcactctgtcgttcggcagggacaaggtagaattagaacatgngctgcactgttntg

SEQ ID NO: 360774 - DNA, 549 bp, Homo sapiens
  misc_feature: GZ8MTXP01EFYKI.21.4.A04.1.454.CMB.2.raw
  modified_base (260)..(260): a, c, t, g, unknown or other
  modified_base (280)..(280): a, c, t, g, unknown or other
  modified_base (297)..(297): a, c, t, g, unknown or other
  modified_base (372)..(372): a, c, t, g, unknown or other
  modified_base (376)..(376): a, c, t, g, unknown or other
  modified_base (401)..(401): a, c, t, g, unknown or other
  modified_base (421)..(421): a, c, t, g, unknown or other
  modified_base (467)..(467): a, c, t, g, unknown or other
  modified_base (501)..(501): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcctgttgttatttacaaggtgtccagtgtgaggtgcagctggtggagtctgggggagacttggtccagcctggagggtccctgagactctcctgtgcagcctntgcatcacttcagtgaccanaacatggactgggtccncaggctcgagggagggctggagtgggtcgacgtatacgaaggaagctaacagttacaagtacaagaatacgggcncgtntggtagaaaggtagtcaccatctanaagagatgatacaaagactnactggtactctagactaaaatgaaacagaccctaaggaaaacccgnggaaccacgggctagttattagttggtaggtaanaaagaaaaggagtggtaatggttaggggtgttaccggtcgttggtaac

SEQ ID NO: 360775 - DNA, 581 bp, Homo sapiens
  misc_feature: GZ8MTXP01BHEIW.21.4.A04.1.454.CMB.2.raw
  modified_base (200)..(200): a, c, t, g, unknown or other
  modified_base (210)..(210): a, c, t, g, unknown or other
  modified_base (232)..(232): a, c, t, g, unknown or other
  modified_base (238)..(238): a, c, t, g, unknown or other
  modified_base (290)..(290): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaggggaaanagccaccctntcctgcagctcagccagaatanccaganctactacatagcctggaccagcagacgcctggccaggcctcccgaggttccnatctatcgctcgggtcccagcggcccagtggcactcccagacaggttcaggtggctaggtgggtctggggacagtaccttcacttctacatctatagcagactggacgtctagaagtattcgactagttgttaagtttacgtgttacagtctaagtagttaggtaaacttctaccgttcgtcggttccggttaacggaaccgaaaggggtaaccaaagggtaaacgtaaagttacggaaaacgttacgttaagggtacggtaactcggacttaccgtaagttcgttaaccg

SEQ ID NO: 360776 - DNA, 551 bp, Homo sapiens
  misc_feature: GZ8MTXP01BCRT7.21.4.A04.1.454.CMB.2.raw
  modified_base (217)..(217): a, c, t, g, unknown or other
  modified_base (300)..(300): a, c, t, g, unknown or other
  modified_base (469)..(469): a, c, t, g, unknown or other
  modified_base (504)..(504): a, c, t, g, unknown or other
  modified_base (513)..(513): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccagcctggagggtccctgagactctcctgtgcagcctctgcatcaccttcagtgaccacaacatggactgggccncaggctcgaggggaggctggagtgggcgcgtatacgaaggaagctaacagttacaagtacaagaaacgtacgggcgcgtctaggtagaaaggtagttcaccatctacaagagatgattacaaagtaactcactggtatctagacaaatgaacagacctagaaaacccgngaacgacggtaacgtgttaattagttgtaggtaanaagaaaggngtaaggtagtaaggtgggtaggttacgtgttggtaacg

SEQ ID NO: 360777 - DNA, 565 bp, Homo sapiens
  misc_feature: GZ8MTXP01ATEIX.21.4.A04.1.454.CMB.2.raw
  modified_base (256)..(256): a, c, t, g, unknown or other
  modified_base (263)..(263): a, c, t, g, unknown or other
  modified_base (301)..(301): a, c, t, g, unknown or other
  modified_base (348)..(348): a, c, t, g, unknown or other
  modified_base (354)..(354): a, c, t, g, unknown or other
  modified_base (480)..(480): a, c, t, g, unknown or other
  modified_base (528)..(528): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctggagggtccctgagactctcctgtncagcctntgcatcaccttcagtgactacaacatggactgggtccncaggctccgaggggaggggctggagtgggtcgcgtatacgaaggaanctaacngttacaagtacaagaatacgggcgcgtctaggtagaaaagggtagttcaaccgatcacaaagagatgaattacaaagaactcaactggtatctagacaaatgaaacacgacctagaaaaacccggnggaaccgacggtcgttagttattagttggtaaggtaagaacgaaaggnggtaaggagtgggtgggtaggttactcgttggtaacg

SEQ ID NO: 360778 - DNA, 552 bp, Homo sapiens
  misc_feature: GZ8MTXP01EQR9L.21.4.A04.1.454.CMB.2.raw
  modified_base (287)..(287): a, c, t, g, unknown or other
  modified_base (301)..(301): a, c, t, g, unknown or other
  modified_base (344)..(344): a, c, t, g, unknown or other
  modified_base (349)..(349): a, c, t, g, unknown or other
  modified_base (378)..(378): a, c, t, g, unknown or other
  modified_base (512)..(512): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttgggtccagcctggagggtccctgagactctcctgtgcagcctctgcatcaccttcagtgaccacaacntggactggggtccncaggctccgaggggagggctggagtggcgcgtatacaaggaanctaanagttacaagtacaagaatacgggcgcgtntggtagaaagggagttcaccatctacaagagatgaattacaaaagaactcgactggtactctagacaaatgaacagacctagaaaaccgagaccacggccgtagttacttattggtaggtaagaaacgaaaagnggtaaggagttaaggtgggtacggttagtcgttgtaacgg

SEQ ID NO: 360779 - DNA, 557 bp, Homo sapiens
  misc_feature: GZ8MTXP01DHBKY.21.4.A04.1.454.CMB.2.raw
  modified_base (301)..(301): a, c, t, g, unknown or other
  modified_base (464)..(464): a, c, t, g, unknown or other
  modified_base (483)..(483): a, c, t, g, unknown or other
  modified_base (523)..(523): a, c, t, g, unknown or other
  modified_base (547)..(547): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacttggtccagcctgggagggtccctgagactctcctgtgcagcctctgcatcacttcagtgaccacaacatggactgggccncaggctcgagggaggctggagtggtcgcgtatacgaagaagctaacagttacaagtaacaagaaatacgggcgcgtctaggtagaaaaggagttcaaccgtatctacaaagagaatgaattacaaaagaacctcaacttggtattcgagacaaaatcgaaacnggacctaaggaaaacccgnggacacggtctagttattattggtagtaagaaagaaaggngtggaattgggtcggtggttacgngttggtaacg

SEQ ID NO: 360780 - DNA, 568 bp, Homo sapiens
  misc_feature: GZ8MTXP01B3ESW.21.4.A04.1.454.CMB.2.raw
  modified_base (197)..(197): a, c, t, g, unknown or other
  modified_base (205)..(205): a, c, t, g, unknown or other
  modified_base (228)..(228): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcacctgtctttgctcaggggaangccacctntcctgcagctccagccagaatanccagagctaactacatacgcctggtaccagcagaagcctggccaggcctcccaggttcctcatctatgcgtcgggtccccacgacgggcccacgtggccatcccagactacggttcaggtggcaggtgggtctgggacagtacttcactctcatcattagcagactggacgtctagagtattcgctagtgttattactgtacagtctagttagtaggtaacgttctaccgttcgttcggtccggttaacggaccggttaaagggaaccgttaaagggtaaacgtaaagttacggaaacgaacgttgggcggtaactcggacttaccgtaattccgtttcg

SEQ ID NO: 360781 - DNA, 572 bp, Homo sapiens
  misc_feature: GZ8MTXP01BY3RA.21.4.A04.1.454.CMB.2.raw
  modified_base (284)..(284): a, c, t, g, unknown or other
  modified_base (348)..(348): a, c, t, g, unknown or other
  modified_base (533)..(533): a, c, t, g, unknown or other
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctctgcatcacttcagtgaccacaacntggactgggtccgcaggctccgagggagggctggagtgggtcgcgtatacgaaggaaagctaanagttacaagtacaagaatacggcgcgtactggtagaaaggagttcaaccatctacaagagatagattacaaagactcaactggtaatcgtagacaaatcgaaacagtacccgtaagaaaaccccggagggaaccaaccggggtccgtaagttagtttaagttggtaaggtaacgaaagaaaaggnggtaagggaattgggtcgggtggttagtcgttggtaacg

SEQ ID NO: 360782 - DNA, 549 bp, Homo sapiens
  misc_feature: GZ8MTXP01B5BDA.21.4.A04.1.454.CMB.2.raw
  modified_base (201)..(201): a, c, t, g, unknown or other
  modified_base (268)..(268): a, c, t, g, unknown or other
  modified_base (290)..(290): a, c, t, g, unknown or other
  modified_base (380)..(380): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagagctaactacatagcctggtaccagcagancctggccaggctccaggttccnatctatgctcggtcccagcggcccagtggcactcccagacaggttcagtggcaggtgggctgggacagtcttcactctcatcatagcagntgggatccgtagtaagtactttcgactagttagttattacgtgtcagtctaagtataggtaacgtctaccgtgttcggtcgttcggaaccgttaaagggaccttaaagggtaaagaaagttaggaaaaccgttagtgggttacgctcggaccttacgtaacttcgttcg

SEQ ID NO: 360783 - DNA, 557 bp, Homo sapiens
  misc_feature: GZ8MTXP01EOOPP.21.4.A04.1.454.CMB.2.raw
  modified_base (302)..(302): a, c, t, g, unknown or other
  modified_base (408)..(408): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagccgtggagggtccctgagactctcctgtgcagcctctgcatcaccttcagtcgaccacaacatggactggggtccnccaggctacgaggggagggctggagtgggtcgcgtatacaaaggaagctaaacagttacaaagtacaagaatacgggcgcgtctggagaaaggagttcacatctanaagagatgaacttacaaaagaactcgaacttggtaacttcgtagacaaatgaaacagacctagaaaaccgaggaccacggtcgtattagttagttgtacggtaagaaacgaaagaggtgggattggtgggtcggttagcgttggtaacg

SEQ ID NO: 360784 - DNA, 591 bp, Homo sapiens
  misc_feature: GZ8MTXP01EUCYC.21.4.A04.1.454.CMB.2.raw
  modified_base (249)..(249): a, c, t, g, unknown or other
  modified_base (293)..(293): a, c, t, g, unknown or other
  modified_base (300)..(300): a, c, t, g, unknown or other
  modified_base (315)..(315): a, c, t, g, unknown or other
  modified_base (363)..(363): a, c, t, g, unknown or other
  modified_base (374)..(374): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctccccaggctcagaaaccaccggagaaattgtgttgacgcagtctccaggcaccctgtctttgtctaccgcgggaaaagcgcccaccctctcgtgcagctccagccaagatatccagagctactnatagcctggtaccagcagaagcctggccaggctcccaggttccncatctanggctcggtcccacgnggccacgtggccatcccagacaggttcagtggcagtgggtctgggacngcttcatctcnctactatagacagcgaggacgctagtaagtacgttcgacgtagtgttacgctttcgtagtacgtacgtacgtaggtaacgttacgtaccgttccgtaccgtccggttccgggtaaccggtaaccgggaaaccggaaacgggaacggtaaaacggtacaaaaacggttacggaacggtaacggtcgtcgaccgtaccgttacgtaaccgttcgttccg

SEQ ID NO: 360785 - DNA, 578 bp, Homo sapiens
  misc_feature: GZ8MTXP01C9ZLX.21.4.A04.1.454.CMB.2.raw
  modified_base (281)..(281): a, c, t, g, unknown or other
  modified_base (303)..(303): a, c, t, g, unknown or other
  modified_base (345)..(345): a, c, t, g, unknown or other
  modified_base (350)..(350): a, c, t, g, unknown or other
  modified_base (378)..(378): a, c, t, g, unknown or other
  modified_base (411)..(411): a, c, t, g, unknown or other
  modified_base (524)..(524): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtgcagcctctgcatcaccttcagtnaccacaacatggactgggtccncaggctcgagggagggctggagtggcgcgtatacgaaggaanctaanagtacaagtacaagaatacggcgcgtcnggtagaaaggtagttcacctatctacgaaaganatgaattacaaaagtactacaacttggtaactcgtagacaaatcgaaacagtacctaagaaaacccggaggaaccgacgggtccgttagttaatttagttaggtaagggtaanaaaacgaaaaggttaggttgggaattgggttgggtaggttacgtcgttgtaacg

SEQ ID NO: 360786 - DNA, 578 bp, Homo sapiens
  misc_feature: GZ8MTXP01D4RGM.21.4.A04.1.454.CMB.2.raw
  modified_base (218)..(218): a, c, t, g, unknown or other
  modified_base (264)..(264): a, c, t, g, unknown or other
  modified_base (276)..(276): a, c, t, g, unknown or other
  modified_base (280)..(280): a, c, t, g, unknown or other
  modified_base (285)..(285): a, c, t, g, unknown or other
  modified_base (289)..(289): a, c, t, g, unknown or other
  modified_base (301)..(301): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtggggganacttggtccagcctggagggtccctgagactctcctgtgcagcctntgcatcaccttnagtnaccanaacntggactgggccncaggctcgagggagggctggagtggtcgcgtatacgaaggaagctaacagttacaagtaacaaggaatacgggcgtcgtgtaggtaggaaaggtagttcaaccatactacaaagagatagattacaaaagaactacaacgtggtaatctagacaaatgaaacagacccgtaagaaaaccgaggaaccgacgggtcgtagttaattagttaggtaaggtaagaaagttaaaaggaggttaagggaattgggttggggtacggttagtcgttggtaacg

SEQ ID NO: 360787 - DNA, 522 bp, Homo sapiens
  misc_feature: GZ8MTXP01EPN96.21.4.A04.1.454.CMB.2.raw
  modified_base (200)..(200): a, c, t, g, unknown or other
  modified_base (209)..(209): a, c, t, g, unknown or other
  modified_base (290)..(290): a, c, t, g, unknown or other
  modified_base (461)..(461): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctntcctgcagctccagccagaatatccagagctactacatagcctggtaccagcagaagcctggccaggcctcccaggttccnatctatgctcgggtaccccagacgggcccagtggcactcccagactacggttcaggtggcaggtgggtctggggacagtcttcactctcatctatagcagactggacgcgtagaacgtattcgactagttgtaattacgtgtacagactagtagtaggtaacttctacttntgtcgtcgacgaagggacaaggtaagaagttagaaacgactgtgtctgccactaattcgtg

SEQ ID NO: 360788 - DNA, 588 bp, Homo sapiens
  misc_feature: GZ8MTXP01BZCLT.21.4.A04.1.454.CMB.2.raw
  modified_base (217)..(217): a, c, t, g, unknown or other
  modified_base (307)..(307): a, c, t, g, unknown or other
  modified_base (361)..(361): a, c, t, g, unknown or other
  modified_base (496)..(496): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccaggcctggacgggtccctgagactctcctgtgcagcctctgcatccaccttcagtcaccacaacatggacctggggtcccncgaggcctcgagggggagggctgggagtgggtcgcgtatacgaaggaagctaanagtacaagtacaaggaaagtacgggcgtcgtcgtaggtagaaaagggagttcacctatctacaagagatgaattacaaaagactcacttggtaattcgtagaacaaatgaaacagaccctaaaggaaaacccggnggaccacgggtcgttagttatttagttaggtagggtaaagaacgaaaaggttggttaagggagttgggtgggtaggttagtcgttggtaacg

SEQ ID NO: 360789 - DNA, 539 bp, Homo sapiens
  misc_feature: GZ8MTXP01BPYYP.21.4.A04.1.454.CMB.2.raw
  modified_base (199)..(199): a, c, t, g, unknown or other
  modified_base (288)..(288): a, c, t, g, unknown or other
  modified_base (394)..(394): a, c, t, g, unknown or other
  modified_base (403)..(403): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaagcctggccaggctcccaggttccncatctatcgctgggtccccacgacgggcccacgtggccatcccagacaggttcagtggcaggtgggtctgggacagacttcactctcatcattagcagactggacnctagaagtnttcgctagtgtatttactgttcagctagtagtggaagttcaccttctcggttcggttcggaccgaaagggtaccaaagggtaagaaagttaggaaacgttacgtggttagggctcggacacctaagttcgttaacg

SEQ ID NO: 360790 - DNA, 567 bp, Homo sapiens
  misc_feature: GZ8MTXP01D0RT5.21.4.A04.1.454.CMB.2.raw
  modified_base (201)..(201): a, c, t, g, unknown or other
  modified_base (210)..(210): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctntcctgcagctccagccagaatatccagagctactacatagcctggtaccagcagaagcctggccaggctcccaggttcctcatctatgcttgggtccccacgagggcccacgtggcactcccagacaggttcagtgcagtgggtctgggacagacttcactctcatcattagcagactggacgcctagaagtattcgactagttgttattacgtgttcagtctaagtagtggtaaacgttctaccgttcgttcggtcggttccggaccgttaaaggggaacccttaaagggtaagaaacgttacggaaaacgttaacgttgggtaggtcgtacggaccttacctaacgttcgtttcg

SEQ ID NO: 360791 - DNA, 635 bp, Homo sapiens
  misc_feature: GZ8MTXP01CZOLG.21.4.A04.1.454.CMB.2.raw
  modified_base (216)..(216): a, c, t, g, unknown or other
  modified_base (302)..(302): a, c, t, g, unknown or other
  modified_base (351)..(351): a, c, t, g, unknown or other
  modified_base (356)..(356): a, c, t, g, unknown or other
tcagtcgtcgctcgcacgaccggtgctcgatttagagtagtgatcaggggagctctgagagcggagtcccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagccctctgcatcaccttcagtcgaccacaacatggactgggtccnccaggcctcgagggggagggctgggagtgggtcgcgtatacgaaggaanctaanagttacaagtacaagaagtacgggcgtcgtcgtaggtaggaaagggtaacgttcaaccctatctaacaaaggagtatagaactttacgaaaagtaactactaacgttaggtaactctagaacctaaaagtcgaaacgagtacccgtaaggaaaaaccccggaggaacccgaccggggtaaccgttagttaaagttttagttagggttagggtaaagttaaacgaaaagggttggttaagggtaatggggttagggtagggttaatcggttaaggtaacg

SEQ ID NO: 360792 - DNA, 545 bp, Homo sapiens
  misc_feature: GZ8MTXP01B1PYE.21.4.A04.1.454.CMB.2.raw
  modified_base (200)..(200): a, c, t, g, unknown or other
  modified_base (239)..(239): a, c, t, g, unknown or other
  modified_base (288)..(288): a, c, t, g, unknown or other
  modified_base (415)..(415): a, c, t, g, unknown or other
  modified_base (440)..(440): a, c, t, g, unknown or other
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccaganctactacatagctggtaccagcagagcctggccaggcctccaggttccncatctatcgctcgggtcccacgcgggcccacgtcggcacgtcccagacaggttccaggtggcaggtgggtctgggacagtacttcacttctcatcattacgcagactggaacgctagaagtattcgntagtgtattacgtgtacagctagtntaggaacgttctacgtctcgtcgtcggacgttaaagggacttaagggtaaagaagttacggaaacgttacgtggtacggcttcggacttacctaagttccgtaag

SEQ ID NO: 360793 - DNA, 554 bp, Homo sapiens
  misc_feature: GZ8MTXP01A5SLR.21.4.A04.1.454.CMB.2.raw
  modified_base (201)..(201): a, c, t, g, unknown or other
  modified_base (293)..(293): a, c, t, g, unknown or other
  modified_base (315)..(315): a, c, t, g, unknown or other
  modified_base (426)..(426): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatagcctggtaccagcagaagcctggccaggcctccgaggttcctnatctatgctcgggtccccacgngggcccacgtggccactccccaggaccacgggtttccaggtggcagggttcggggtcctggggaacaggtactttccactctacatcattagcagactggagcctagagtnttcgctagtgtattacgtgtacagctagtagtggtaacgttctacctgtcgtcggttccggacgaaggggaccaaagggtaagaaagttacggaaacgttacgtggtcggctgaccacctaagttctg

SEQ ID NO: 360794 - DNA, 506 bp, Homo sapiens
  misc_feature: GZ8MTXP01DAUQW.21.4.A04.1.454.CMB.2.raw
  modified_base (201)..(201): a, c, t, g, unknown or other
  modified_base (210)..(210): a, c, t, g, unknown or other
  modified_base (290)..(290): a, c, t, g, unknown or other
  modified_base (371)..(371): a, c, t, g, unknown or other
  modified_base (444)..(444): a, c, t, g, unknown or other
  modified_base (473)..(473): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctcccaggttccncatctatgctgggtccccagagggcccacgtggcatcccagaccaggttcagtgcagtgggtctgggacagacttcactcncatcattagcagactggagcctagaagtatttcgctagtgttattactggtcagctagtatggtaattcactntcgtcgttcgcgagggacaaggtaagaanagaacacgtgtagctgcttacctaattcgttcg

SEQ ID NO: 360795 - DNA, 609 bp, Homo sapiens
  misc_feature: GZ8MTXP01CUITM.21.4.A04.1.454.CMB.2.raw
  modified_base (418)..(418): a, c, t, g, unknown or other
  modified_base (424)..(424): a, c, t, g, unknown or other
  modified_base (552)..(552): a, c, t, g, unknown or other
  modified_base (565)..(565): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctatcacctcagtgaccacaacatggactcgggtccgccaggctaccgaggggagggctggagtgggtcgcgtatacgaaggaagactaacagttaacaagttacaagaaactacgggcgcgtctagtaggaaaggtacgttcaacctatcanaaaggngtaatagaattacaaagaactcaacttggtactactagaactaaagtcgaaacacggaccctaaacggaaaaccggaggtaaccgaccgggtaaccgttagttaagttttagttaggttaagggtaanaaaccgaaaaggnggttaagggaagttcgggtgggttaggttagtcgttggtaaccg

SEQ ID NO: 360796 - DNA, 596 bp, Homo sapiens
  misc_feature: GZ8MTXP01AZDIX.21.4.A04.1.454.CMB.2.raw
  modified_base (216)..(216): a, c, t, g, unknown or other
  modified_base (264)..(264): a, c, t, g, unknown or other
  modified_base (276)..(276): a, c, t, g, unknown or other
  modified_base (304)..(304): a, c, t, g, unknown or other
  modified_base (350)..(350): a, c, t, g, unknown or other
  modified_base (547)..(547): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgagactctcctgtgcagcctntgcatcaccttnagtcgaccacaacatggactggggtccncaggcctcgaggggacgggctggagtgggtcgcgtatacaaggaanctaacagttacaagtacaagaactacgggcgcgtactggtaagaaacgggtaggttcaacctatcctacaaagagatagtaattacaaaacgacttacacgttggtaatcgtagacaaatcgaaacagaccctaagaaaacccgaggaaccacggtaaccgttgttaagtttagttttgggaaagtaacgaaaaggngttagggtaattggggttgggttaggtaccggttgtggttaacgtaacg

SEQ ID NO: 360797 - DNA, 618 bp, Homo sapiens
  misc_feature: GZ8MTXP01AKZ1G.21.4.A04.1.454.CMB.2.raw
  modified_base (306)..(306): a, c, t, g, unknown or other
  modified_base (352)..(352): a, c, t, g, unknown or other
  modified_base (565)..(565): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggggagacttggtccagccgtgggacgggtccctgagactctcctgtgcagcctctgcatccaccttcagtcgaccacaacatggactggggtccncgaggctccgaggggagggctggagtgggcgcgtatacgaaggaanctaacagttacaagtacaagaataccgggcgcgtctggtagaaaggacgttcaaccgtatctacaaagagatagaacttacaaaagtaactcaacttggttaactcgtagaacaaaatgaaacgacgacccgtaagaaaacccggaggaacccgacgggtaaccgttaggttaaattaagtttggaagggttaaacgaaacgttaaaaagggnggttaaggggagttgggttaggggtacgggttaagtccggttaaggtaaccgg

SEQ ID NO: 360798 - DNA, 560 bp, Homo sapiens
  misc_feature: GZ8MTXP01AMS1I.21.4.A04.1.454.CMB.2.raw
  modified_base (200)..(200): a, c, t, g, unknown or other
  modified_base (288)..(288): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanagccaccctctcctgcagctccagccagaatatccagagctactacatagcctggtaccagcagagctggccaggcctccaggttccnatctatgctgggtccccagagggcccagttcggcactcccagactagggttcaggtggctaggtgggtctgggacagtacttcactctcatcattagcagactggacgcctagaagtattcgactagttgtacttacgtgtcaagtcaagttatgggtaacttcgtaaccttcgtgttccggttcggaccgaaaggggtaccaaagggtaacgtaaagttaggaaaccgttaagttgggtacggtctacggaccttaccgtaagttcgttcg

SEQ ID NO: 360799 - DNA, 617 bp, Homo sapiens
  misc_feature: GZ8MTXP01BGE6M.21.4.A04.1.454.CMB.2.raw
  modified_base (216)..(216): a, c, t, g, unknown or other
  modified_base (304)..(304): a, c, t, g, unknown or other
  modified_base (349)..(349): a, c, t, g, unknown or other
  modified_base (521)..(521): a, c, t, g, unknown or other
  modified_base (581)..(581): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccaatgtgaggtgcagctggtggagtcgtggggganacttggtccagccctgggagggtcccctgagactctcctgtgcagccctctgctatcaccttcagtcaccacacatggactgggtccncaggctcgaggggagggctggagtgggtcgcgtatacaaggaagntaacagttacaagtacaagaaatacgggcgcgtctagggtaagaaaacgggtaaggttaccaaccctatacctaacgaaaggaggatagtaacttacgaaaaagtaaccttacaacttgggtaaactcgtagaaccaaaagtgaaacacggacccgtaaaggaaaaacccgnggaaacccgacgggtaaccgtaggttaattaagttggtagggtaagaaacgttaaaaggngttaagggagtggtagggtggttagtcgttggaacg

SEQ ID NO: 360800 - DNA, 731 bp, Homo sapiens
  misc_feature: GZ8MTXP01B48XX.21.4.A04.1.454.CMB.2.raw
  modified_base (217)..(217): a, c, t, g, unknown or other
  modified_base (260)..(260): a, c, t, g, unknown or other
  modified_base (265)..(265): a, c, t, g, unknown or other
  modified_base (277)..(277): a, c, t, g, unknown or other
  modified_base (286)..(286): a, c, t, g, unknown or other
  modified_base (304)..(304): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtggggganacgttggtccagccgtggacgggtccctgagactctctgtgcngcctngctatcaccttnagtcaccanaacatggactggggcccncgaggcctaccggagggggaacgggggtctaggggacggttcgggggtaccggaccgttaaagttaaccgaaaaggggaaaacgtacttaaaacgtaacgtttaaacgaaaacgttaaccaaggtaaacgtacccggggcgtaccggtacgtagggtaaaggaaaaacgggtacggttccaaccgtatctaacgaaagaagtatagtaattaacaaaacgtactcaacgttgggtaacttctaaggaactaaaataccggaaactacggtaaccctaaacgggaaaaaacccggcgggaaaccgaccgggggtaaccttagtttaaagtttaaggttacgggtaaagggtaaagaaaacgttaaaaaagggttggttaaggggtaacttgggggtagggttacgggttaaggtccgttgggtaaccg

SEQ ID NO: 360801 - DNA, 502 bp, Homo sapiens
  misc_feature: GZ8MTXP01AM7RV.21.4.A04.1.454.CMB.2.raw
  modified_base (201)..(201): a, c, t, g, unknown or other
  modified_base (210)..(210): a, c, t, g, unknown or other
  modified_base (291)..(291): a, c, t, g, unknown or other
  modified_base (472)..(472): a, c, t, g, unknown or other
  modified_base (496)..(496): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctcccaggttcctnatctatgctgggtccccacgagggcccactggcatcccagacaggttcagtggcagtgggtctgggacagacttcactctcatcattagcagactggagcctagaagtatttcgctagttgttattactgtcagctagtatggtaagttcacctctgtcgtcggcgaagggaccaaggtanaattgaaacgactgtgctgcactnttctcg

SEQ ID NO: 360802 - DNA, 615 bp, Homo sapiens
  misc_feature: GZ8MTXP01CMKYZ.21.4.A04.1.454.CMB.2.raw
  modified_base (537)..(537): a, c, t, g, unknown or other
  modified_base (565)..(565): a, c, t, g, unknown or other
  modified_base (581)..(581): a, c, t, g, unknown or other
  modified_base (604)..(604): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagcctgggagggtccctgagactctcctgtgcagcctctgcattcaccttcagtcgaccaacaacatggacgtgggtccgccgaggctaccgaagggggaggggcgtgggaggtggggtcggaccgtaattacgaaagggaaacgctaaacgagttaacaagtaaacaagaacgtaaccgggcgacggttcgtaggtagggaaaacgggtagggtttacaaccctagtactacgaaaggagtaataggaattaacaaaagtaactacaacttgtactcttagacaaatagaactacgacctaagaaaaccgnggaacacgggcttaagtaattagttagngtaaagaacgaaaagngttaggaatagggtggttggagngtgttcgaacg

SEQ ID NO: 360803 - DNA, 559 bp, Homo sapiens
  misc_feature: GZ8MTXP01AMRXD.21.4.A04.1.454.CMB.2.raw
  modified_base (264)..(264): a, c, t, g, unknown or other
  modified_base (276)..(276): a, c, t, g, unknown or other
  modified_base (303)..(303): a, c, t, g, unknown or other
  modified_base (357)..(357): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagccgtggagggtccctgagactctcctgtgcagcctntgcatcaccttnagtgaccacaacatggactggggtccnccgaggctccgaggggagggctggagtgggtcgcgtatacgaaggaaagctaanagtacaagtacaagaatacgggcgcgtctgagaaaggaggttcaacgatctacaagagatgaattacaaagtaactacactaggtatctagacaaatgaacagacctaggaaaccgagacgacggccgtagttagttagttaggtacggtaagaacgaaaaggttagtaagggagttgggtgggtggttagtcgttgtaacg

SEQ ID NO: 360804 - DNA, 619 bp, Homo sapiens
  misc_feature: GZ8MTXP01AMGEM.21.4.A04.1.454.CMB.2.raw
  modified_base (400)..(400): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctggagggtccctgagactctcctgtgcagcctctgcatccaccttcagtcgaaccacaacagtcggactggggtccccgccgaggcctccgagggggagggggctgggaggtggggtcggccgtaattacgaaaggaaagctaaacgagtacaagtaacaagaatacggngcgtcgtagtagaaaggtacgttcaaccatctacaaagagatgattacaaacgactacactaggtatcgtagactaaatgaaaccaggaccctaacggaaaaccgagggtaacccgaccgggtaaccggttgttaaagttaagtttgggtagggttaaacggaaacgttaaaaaggaggttaagggagttgggtagggtacggttagtcgttggtaacg

SEQ ID NO: 360805 - DNA, 528 bp, Homo sapiens
  misc_feature: GZ8MTXP01BPDK0.21.4.A04.1.454.CMB.2.raw
  modified_base (200)..(200): a, c, t, g, unknown or other
  modified_base (239)..(239): a, c, t, g, unknown or other
  modified_base (289)..(289): a, c, t, g, unknown or other
  modified_base (362)..(362): a, c, t, g, unknown or other
  modified_base (373)..(373): a, c, t, g, unknown or other
  modified_base (382)..(382): a, c, t, g, unknown or other
  modified_base (387)..(387): a, c, t, g, unknown or other
  modified_base (392)..(392): a, c, t, g, unknown or other
  modified_base (407)..(407): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanagccaccctctcctgcagctccagccagaatatccaganctactacatagcctggaccagcagaacgctggccaggctcccaggttccnatctatcgctcgggtccccagacgggcccacgtggcactcccagacaggttcaggtgcaggtgggctgggacngacttcactcnatcatacgnagacnggacnccgtagagtattcgntagtgtattcgtgtacagcagtagtggtaacttcaccttgtcggttcggtcggaccgaagggtaccaaaggtagaaacgttagaaacgacgtggtcgtcgtcgaccactaattcgttaacg

SEQ ID NO: 360806 - DNA, 523 bp, Homo sapiens
  misc_feature: GZ8MTXP01D7FC7.21.4.A04.1.454.CMB.2.raw
  modified_base (199)..(199): a, c, t, g, unknown or other
  modified_base (208)..(208): a, c, t, g, unknown or other
  modified_base (288)..(288): a, c, t, g, unknown or other
  modified_base (309)..(309): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctntcctgcagctccagccagaatatccagagctactacatagcctggtaccagcagagctggccaggcctcccaggttcctnatctatgctcgggtcccacgngggccacgtggcactcccagactacggttcagtggcaggtcgggtctggggacacgtaccttcactctctatcattagcagactggacgtcgtagaagtattcgctagttgttattactgtacagtcagtagtggtaattctactcgtgtcgtcgacgaaggacgttaaggtaagtaagttagaaacgacgtgacgtcgtgcactaattcgtcg

SEQ ID NO: 360807 - DNA, 610 bp, Homo sapiens
  misc_feature: GZ8MTXP01AGBIE.21.4.A04.1.454.CMB.2.raw
  modified_base (266)..(266): a, c, t, g, unknown or other
  modified_base (306)..(306): a, c, t, g, unknown or other
  modified_base (506)..(506): a, c, t, g, unknown or other
  modified_base (522)..(522): a, c, t, g, unknown or other
  modified_base (529)..(529): a, c, t, g, unknown or other
  modified_base (551)..(551): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggaggtcgtgggggagacttgggtccaggccgtggagggtccctgagactctcctgtgcagcctntgcatcaccttcagtcgaccacaacatggactcggggccnccgaggctccgagggggaagggctgggaggtggggtcgccgtaagttacgaaaggaacgctaaacgagttacaaagttacaagtaaagtaccgggctacgtcgtagggtagaaaagggtacggttcaacctatcctaacgaaagagatagtaacttacgaaaagaactcgtaactgggtaatcgtgaacaaatcgaaacngacctaggaaaaccgnggaaccncgggtctagttattagttaggnggtaaagaacgaaaaggttggtaagggattgggggttgggtggttactcggttgtaacg

SEQ ID NO: 360808 - DNA, 494 bp, Homo sapiens
  misc_feature: GZ8MTXP01DHY96.21.4.A04.1.454.CMB.2.raw
  modified_base (202)..(202): a, c, t, g, unknown or other
  modified_base (287)..(287): a, c, t, g, unknown or other
  modified_base (303)..(303): a, c, t, g, unknown or other
  modified_base (358)..(358): a, c, t, g, unknown or other
  modified_base (379)..(379): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaaatatccagagctaactacatagcctggtaccagcagaagctggcagctccagtcnatcatgctggtcccanaggccactggcatccagacaggttcagtggcagtgggctgggacagacttcactntcatcattagcagactggaancctagaagtattcgctagtgtattactgtacagtcagtatggaaagttcacctgtgtcgttcggccaaagggaccaaaggtaagaattagaacgaatgtagctgcacaattcgtg

SEQ ID NO: 360809 - DNA, 663 bp, Homo sapiens
  misc_feature: GZ8MTXP01CGJ32.21.4.A04.1.454.CMB.2.raw
  modified_base (218)..(218): a, c, t, g, unknown or other
  modified_base (268)..(268): a, c, t, g, unknown or other
  modified_base (315)..(315): a, c, t, g, unknown or other
  modified_base (550)..(550): a, c, t, g, unknown or other
  modified_base (603)..(603): a, c, t, g, unknown or other
  modified_base (648)..(648): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtggggganacgttggtccaggcctgggacgggtccctgagactctcctgtgcagcctntgctatccaccttcagtcgaccaacaacagtggacctcggggtcccnccgaggccgtaccgagggggaagggggctgggaggtcggggtcggaccgtattaacgaaaggaagactaaagagttacaagtaacaagaatacggcgcgtctaggtagaaagggtagttccaacgtatctacgaaaggagtaatacgaaattaaccgaaaagtaaccttcaacgttggttaacttccgtagaacaaaagttcgaaacgtacgaacccgtaaagaaaaccccgggnggtacccgaacggggtcccgttaagttaagtttaaggttggtaaacgggtaanaaaacggaaaaggttgggtcgtaaggtggtttcggggaggtttanccggttaaggtaacg

SEQ ID NO: 360810 - DNA, 789 bp, Homo sapiens
  misc_feature: GZ8MTXP01C62H5.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccaggcctgggacgggtccctgacgactctcctgtgcagcctctgctatccaccttcagtcgaacccaacaacagtggacctcggggtccccaccgaggcctaccggaagggggaacgggggtcgtgggggaggttcgggggtccggtaccgttaaagttaaccggaaaaggggtaaaacgacgttaaacgtaagtttaaaccgaaagggttaaaccaaggtaaaacgtaccgggacggtaccggttacgtaggggtaaagggaaaacggggtaacggtttacccaaacccgtaagttaccgtaaccgaaaaaggaggtaaattaggtaaacttaaacaaaaaagtaccttacgaacctttagggttaacttccgtaagaaaccaaaattacgggaaaaccacggtaaacccgtaaacgggaaaaaacccgggaggaacccggaaccgggttaaccggttaaggtttaaacgtttagttagggttaaagggtaacgaaaaacggaaaaggttagggtaagggtaagttggggttcggggtaggttaggtccgttaaggtaaccg

SEQ ID NO: 360811 - DNA, 623 bp, Homo sapiens
  misc_feature: GZ8MTXP01CY81R.21.4.A04.1.454.CMB.2.raw
  modified_base (267)..(267): a, c, t, g, unknown or other
  modified_base (311)..(311): a, c, t, g, unknown or other
  modified_base (457)..(457): a, c, t, g, unknown or other
  modified_base (533)..(533): a, c, t, g, unknown or other
  modified_base (586)..(586): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggatacgttggtccagccgtggacgggtccctgagactctcctgtgcagcctntgctatccaccttcagtcgacccacaacatggactggggtcccnccgaggcctccgagggggaaggggctgggaggtgggtcgaccgtagttaacgaaaggaaagctaaacgagttaacaaaggttaacaagaaacgtacgggcgtcgtacgtaggtagaaaaggggtagtttccaaacctatccgtaanaaaggagattagaattaaccaaaagtactacaactaggtactctagacaaatcgaaacagaccctaagaaaaccgngaccgacggaaccgttgttatttagttggtaaggtaagaaaacgttaaaaggngttaaggaagtggtcgggtaggttagtcgttgtaacg

SEQ ID NO: 360812 - DNA, 550 bp, Homo sapiens
  misc_feature: GZ8MTXP01D3V67.21.4.A04.1.454.CMB.2.raw
  modified_base (261)..(261): a, c, t, g, unknown or other
  modified_base (299)..(299): a, c, t, g, unknown or other
  modified_base (485)..(485): a, c, t, g, unknown or other
  modified_base (512)..(512): a, c, t, g, unknown or other
  modified_base (521)..(521): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggaggtccctgagactctcctgtgcagcctntgcatcaccttcagtcgaccacaacatggactgggccncaggctcgaggggaggctggagtggcgcgtatacgaaggaagctaaacagttacaagtacaagaataccgggcgacgtctagggtagaaaagggtagttacaaccgtatctacaaagagatgaattacgaaaagactcaacttggtaatcgtagaactaaatgaaacagaccctaagaaaacccgnggacacggctagttattattgaggaanaacgaaagngtggtagtgtgggcggttagcgttggaac

SEQ ID NO: 360813 - DNA, 536 bp, Homo sapiens
  misc_feature: GZ8MTXP01CBDNA.21.4.A04.1.454.CMB.2.raw
  modified_base (216)..(216): a, c, t, g, unknown or other
  modified_base (274)..(274): a, c, t, g, unknown or other
  modified_base (301)..(301): a, c, t, g, unknown or other
  modified_base (345)..(345): a, c, t, g, unknown or other
  modified_base (350)..(350): a, c, t, g, unknown or other
  modified_base (409)..(409): a, c, t, g, unknown or other
  modified_base (456)..(456): a, c, t, g, unknown or other
  modified_base (471)..(471): a, c, t, g, unknown or other
  modified_base (475)..(475): a, c, t, g, unknown or other
  modified_base (507)..(507): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtggggganacttggtccagcctggagggtccctgagactctcctgtgcagcctctgcatcaccttnagtgaccacaacatggactggggtccncaggctcgaggggagggctggagtggtcgcgtatacgaaggaanctaanagtacaagtacaaggaatacgggcgcgtctaggtagaaagggtagttcaccgtatctanaagagatgattacaaagactcacttggtatctagacaaatcgaaacngacctagaaaaccgngacncggctgttattagttgtaggtagaacgaaagngtggatggtcggtgttagtcgttgtaacg

SEQ ID NO: 360814 - DNA, 603 bp, Homo sapiens
  misc_feature: GZ8MTXP01DN95M.21.4.A04.1.454.CMB.2.raw
  modified_base (264)..(264): a, c, t, g, unknown or other
  modified_base (291)..(291): a, c, t, g, unknown or other
  modified_base (307)..(307): a, c, t, g, unknown or other
  modified_base (355)..(355): a, c, t, g, unknown or other
  modified_base (362)..(362): a, c, t, g, unknown or other
  modified_base (569)..(569): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacggtccctgagactctcctgtgcagcctntgcattcacttcagtcgaaccacaacngtggactcgggtcccncaggcctacgaggggagggctgggagtgggtcgcctatagaaggaacnctaaacngtaacagtaaacgagaagtacgggcgtacgtcgtaggtaaggaaagggtaacggttaccaacctaatactacgaaagagtaatagtaattaacgaaataactacaactgtactacgttagaacaaagtacgaaacacgaccgtaaagaaaccgacggaacaccggcgttaagtaagttagtaggttaggtaaagtaacgaaaaaggnggttagaagtaggtggtaggtagcgtgcgtaacg

SEQ ID NO: 360815 - DNA, 585 bp, Homo sapiens
  misc_feature: GZ8MTXP01EU852.21.4.A04.1.454.CMB.2.raw
  modified_base (203)..(203): a, c, t, g, unknown or other
  modified_base (245)..(245): a, c, t, g, unknown or other
  modified_base (272)..(272): a, c, t, g, unknown or other
  modified_base (297)..(297): a, c, t, g, unknown or other
  modified_base (422)..(422): a, c, t, g, unknown or other
  modified_base (431)..(431): a, c, t, g, unknown or other
  modified_base (488)..(488): a, c, t, g, unknown or other
  modified_base (575)..(575): a, c, t, g, unknown or other
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanacgccacccctctcctgcagctccagccaagaatatccaganctactacatagcctggaccagcagaancctggccaggctcccgaggttcccnatctatcgctcggggtaccccagacgggcccagtcggacctactccccaagactacggttcagtggctaggttcgggtctgggggaacaggtaccttcaactctcaatctatagcagactggaanctagaagtnttcgacgtagtcttaattacgtggtacaagctaagttagtaggtaaacttcacgttntacggtcgttaacggccgaaaaggggaccttaaagggtaagaaaacttaacggaaaacgttacgtgggtaggcttacgaccaacctnttaacgttcg

SEQ ID NO: 360816 - DNA, 671 bp, Homo sapiens
  misc_feature: GZ8MTXP01AUJFK.21.4.A04.1.454.CMB.2.raw
  modified_base (300)..(300): a, c, t, g, unknown or other
  modified_base (351)..(351): a, c, t, g, unknown or other
  modified_base (417)..(417): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcatcaccttcagtgaccacaacatggactggggtccnccaggcctcgaggggaaggggctgggagtgggtcgcgtagtacgaaggaanctaacgagtacaagtacaagaacgtacggcgtcgtcgtgtaggaaaggtacgttacaaccattcanaaagagatagtaattaaccaaaagtaacctctaacgtaggttactaccgtagaaacctaaagtccgaaacgacgtaacccgaaacggaaaaacccggacgggaaccctaacccgggggtaaccgttaagttttaaagttaacggtttagggtaaacgggttaaagaaaaaccggaaaaagggttggggttaagggtaacccggttgggttaaggggggtacccggttaaagggtccgttaagggggttaacccg

SEQ ID NO: 360817 - DNA, 577 bp, Homo sapiens
  misc_feature: GZ8MTXP01B8E5E.21.4.A04.1.454.CMB.2.raw
  modified_base (200)..(200): a, c, t, g, unknown or other
  modified_base (209)..(209): a, c, t, g, unknown or other
  modified_base (289)..(289): a, c, t, g, unknown or other
  modified_base (411)..(411): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctntcctgcagctccagccagaatatccagagctactacatagcctggtaccagcagagcctggccaggctcccaggttcctnatctatgctgggtccccagacgggcccacgtggccactccccgagacctaggttcaggtggcaggtgggtctggggacagtacttcactctcatcattagcagactggacgtcctagaagtnttcgctagtgttattactgtacagctagtagtaggtaagttcctaccgttcgtcggttccggttaaccgggacgaaacggggtaccgttaaagggtaaacgtaaaacgttacggttaaaacgacgttgggtcgggtaactacggaccttacctaacgttcgtttcg

SEQ ID NO: 360818 - DNA, 604 bp, Homo sapiens
  misc_feature: GZ8MTXP01A8ZXY.21.4.A04.1.454.CMB.2.raw
  modified_base (310)..(310): a, c, t, g, unknown or other
  modified_base (369)..(369): a, c, t, g, unknown or other
  modified_base (375)..(375): a, c, t, g, unknown or other
  modified_base (555)..(555): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggacgggtccctgagactctcctgtgcagcctctgctatccaccttcagtcgaaccacaacagtggactcggggtccccnccgaggcctccgagggggaagggctgggaggtgggtccgacgttataacgaaggaaacnctaaanagttacaaagtaacaagaaatacggcgcgtacgtagggtagaaacgggaacgttcaaccgtatctacaaagagatagaacttacaaagactacacgttaggtatcttacgactaaatgaaacagaccgtaagaaaacccggaggaccacgggtcgttagttatttagttaggtaggtaanaacgaaaaggttgtaagggtatgggttggtaggttagcgttgggtaacg

SEQ ID NO: 360819 - DNA, 668 bp, Homo sapiens
  misc_feature: GZ8MTXP01AXYFK.21.4.A04.1.454.CMB.2.raw
  modified_base (216)..(216): a, c, t, g, unknown or other
  modified_base (469)..(469): a, c, t, g, unknown or other
  modified_base (531)..(531): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctctgcatcaccttcagtcgaccacaacagtggactcggggtcccgaccgaggcctaccggagggggaacgggggctggggaggtggggtccggccgttaagttacgaaaggaacgctaaacgagttaccaaagtacaagaaagtacgggcgcgtctaggtagaaagggacgttcaccatcacgaagagatagaattacgaaagtacctntaactggtaactcgtagaacctaaagtcgaaaccacggtacccgtaaaggaaaaaccccggnggaacccgtaacggggtcccgtttaggttaaagttttaaggttacgggtaaagggtaaacgaaaccggttaaaaaggggttggttggggtaaattgggggttaccgggtagggttaacggtccgttaagggtaaccg

SEQ ID NO: 360820 - DNA, 561 bp, Homo sapiens
  misc_feature: GZ8MTXP01BJJGC.21.4.A04.1.454.CMB.2.raw
  modified_base (200)..(200): a, c, t, g, unknown or other
  modified_base (241)..(241): a, c, t, g, unknown or other
  modified_base (288)..(288): a, c, t, g, unknown or other
  modified_base (417)..(417): a, c, t, g, unknown or other
  modified_base (553)..(553): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagcctccagccaagaatatccaganctacacatagcctggaccagcagagctgccaggcctcccaggttccnatctatgccgtcgggtccccagacgggcccagtcggacactcccagacgtaggttcaggtggcagggtgggtctggggactaggtaccttcgactcgtacatcattagcagtactggactctagaagtnttcgactagtgttattactgtcagtactagtagtaggtaacttctaccgttcgtcggtccggttaacggacgttaaggggaaccttaaagggtaacgtaaagttacggaaacacgtggtcggctggaccttacgtnttcgttcg

SEQ ID NO: 360821 - DNA, 583 bp, Homo sapiens
  misc_feature: GZ8MTXP01CWIGT.21.4.A04.1.454.CMB.2.raw
  modified_base (289)..(289): a, c, t, g, unknown or other
  modified_base (305)..(305): a, c, t, g, unknown or other
  modified_base (355)..(355): a, c, t, g, unknown or other
  modified_base (362)..(362): a, c, t, g, unknown or other
  modified_base (542)..(542): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagactttggtccagccgtgggacgggtcccctggagctctcctgtgcagcctctgcattcacttcagtcaaccanaacatggactgggccnccaggcctccgagggagggctgggagtgggtcgccgtatacgaaggaacnctaaagngttaacagtaaacagaagtacgggcgacgtcgtaggtaggaaaagggacggttacaacccatactacaaagagatagattacaaagaactcactagtatctagaacaaatgaaacacgacctaagaaaaccgtaggaacgacggtccgtgtaattagttagaggtaaagaacgaaaaggngttagggtaatgggtggtagggtacgttcgtgttcgtaacg

SEQ ID NO: 360822 - DNA, 711 bp, Homo sapiens
  misc_feature: GZ8MTXP01AHHH3.21.4.A04.1.454.CMB.2.raw
  modified_base (215)..(215): a, c, t, g, unknown or other
  modified_base (260)..(260): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggaggtccctgagactctcctgtgcagcctntgcattcaccttcagtgacccacaacagtggactcgggtcccgccgaggcctaccggaagggggaacggggcgtgggaggtcgggggtaccggtacccgttaagttaaccgaaagggtaaacgaccttaaacgagtttaacagttaaaccgaagtaacgtacgggccgtacgttcgtaggtaaggaaaacgggtaacggttccaacctatacccgtagaaaggagtaagtagaactttaccgaaaaagtaccttaccaattcggtaacttcgtaggaacaaagtacgaaaccgtacgaaccctaaacgggaaaacccgtcggaaccgtacccgggtccgttaagttaacgttaaggttagggttaaggttaaaccgaaaacgttaaaagggttgggttacgggtaagttcggggtgggttagggtagttccgtttaaggaacggtaacccg

SEQ ID NO: 360823 - DNA, 514 bp, Homo sapiens
  misc_feature: GZ8MTXP01DRJWB.21.4.A04.1.454.CMB.2.raw
  modified_base (212)..(212): a, c, t, g, unknown or other
  modified_base (285)..(285): a, c, t, g, unknown or other
  modified_base (388)..(388): a, c, t, g, unknown or other
  modified_base (394)..(394): a, c, t, g, unknown or other
  modified_base (434)..(434): a, c, t, g, unknown or other
  modified_base (490)..(490): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctntcctgcagctccagccagaatatccagagctatacatagcctggtaccagcagagctggcaggctccagtccnatctatgcgtggtacccagaggcaagtggcatccagacagttcagtgcagtgggctgggacagtacttcactctcatcattagcagtactggagcctagaatnttccgntagtgttattacgtgtacagtcagtatggaaattcacctntgtcggttcgacgaaagggtaccaaaggtaagaaattagaaacgttaactgggtancgtagacttactaacgttcgttcg

SEQ ID NO: 360824 - DNA, 727 bp, Homo sapiens
  misc_feature: GZ8MTXP01BLRHN.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacaaggtgtccagtgtgaggtgcagcgtggtggagtcgtgggggagtacgttggtccagccgtgggacgggtccctgagactctcctgtgcagcctctgctactccaccttcagtacgacccaacaacagtcggaccgtcggggtccccgccgacgggcctacccgggaagggggacgggggtccgtgggggtagggttcgggggttaccggaccggttaagttaaccgaaagggtaaacgtacgtaaacgtagtttaaccaaaggttaacaaggtaaacgtaccgggcgtacggtacgtagggtaagggaaaacgggtacggttaccaaaccgtatccgtaacgaaggaagtatagtaacttaacgaaaagtacctactaaccttaggtaacttacgtagtaacaaaagtcgaaacgacgtaaccccgtaaagaaaacccgggaggtaacccgaccggggtaaccttagttaaagtttagttaggtaaagggttaacgaaagttaaagggttaggtgggtagttgggttaggtagggttactcgttaagtaacg

SEQ ID NO: 360825 - DNA, 649 bp, Homo sapiens
  misc_feature: GZ8MTXP01ET85B.21.4.A04.1.454.CMB.2.raw
  modified_base (261)..(261): a, c, t, g, unknown or other
  modified_base (299)..(299): a, c, t, g, unknown or other
  modified_base (353)..(353): a, c, t, g, unknown or other
  modified_base (442)..(442): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctntgcatcaccttcagtgaccacaacatggactgggtccncgaggctcgaggggagggctggagtgggtcgacgtatacgaaggaagctaaacngttacaagtacaagaatacgggcgcgtactggtagaaagggtagttcaccagtctacaaaggagattagaattacgaaaagaaccttanacgttaggtactcgtagaccaaaagtcgaaacgacgacctaaacggaaaaaaccccggtgggaacccgaaccgggggtaaccgtttaaggtttaaagtttaacgttttggggtaacgggggtttaaaaacgaaaacggttaaaaagggttgggttaacgggtaagtttggggttacggggttagggttacggtcgttaagggtaacg

SEQ ID NO: 360826 - DNA, 730 bp, Homo sapiens
  misc_feature: GZ8MTXP01AV0IJ.21.4.A04.1.454.CMB.2.raw
  modified_base (217)..(217): a, c, t, g, unknown or other
  modified_base (293)..(293): a, c, t, g, unknown or other
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtggagggtccctgagactctcctgtgcagcctctgctatccaccttcagtcgaaccacaacngtggacgtcggggtcccnccgaggcctaccggagggggaacgggggctggggaggttgggggtccggaccgttaattaacgaaaggaaacgactaaacgagttaacaaagttaacaaggtaaacgtaccgggcgtacgttcgtaggtagggaaaacgggtaacggtttccaaaccgtattacccgtaagaaaggtaagtagttagtaaactttaacaaaaagtaaacctctaaccgttaggggttaactaccgttagaaacctaaaatcgaaaacctaggtaaccccgtaaagggaaaaaccccgggaggaacccggtaaccggggtaaccgtttaaggttaacgttttaagttagggttaacgggtaaacgaaaacggttaaaagggttaggtgggtaagtggggttgggtacgggttacgtcgttaagggtaacg

SEQ ID NO: 360827 - DNA, 598 bp, Homo sapiens
  misc_feature: GZ8MTXP01D8HM6.21.4.A04.1.454.CMB.2.raw
  modified_base (285)..(285): a, c, t, g, unknown or other
  modified_base (303)..(303): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtcgcagcctctgcatcaccttcagtcgaccanaacatggactggggtccnccgaggctacgagggggagggctggaggtggtcgcgtatacgaaggaagctaacagttacaagtaacaagaatacggcgcgtctggtagaaaggtagtcaccgatctacaagagatagatacaaagaactcgactaggtaacttctagaacctaaaatcgaaactacgaacccgtaacgaaaaaacccgggaggaaccgacggggtaaccgttaagttatttacgttaggtaaggttaagaaaacgaaaaggttggttaaggagttgggtagggtggttagtaacgttggtaacg

SEQ ID NO: 360828 - DNA, 725 bp, Homo sapiens
  misc_feature: GZ8MTXP01BU4Z4.21.4.A04.1.454.CMB.2.raw
  modified_base (309)..(309): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggacggtccctgagactctcctgtgcagcctctgctatccaccttcagtcgaccacaacagtggacgtcggggtcccnccgacggcctaccggaagggggacgggggcgtgggacggtgggggtccggaccgttaagttaacgaaaagggaaacgactaaacgtagttaacgaaagttaaccaaggtaaacgtaaccgggcgtcgtacgtagggtaagggaaaagggtacggtttaccaacccgtaattccgtaacgaaaaggtaagtattaggaaactttaacgaaaaaacgtaaccttacaaccgttagggtaacttccgtagaaactaaagtacggaaacacggaccctaaaggaaaaacccgggaggaacccgaacggggtaaccggttagtttaagtttaaggttgggtaaaggggtaacgaaaacggaaaaagggttgggttaagggtgttaacggggttgggttacgggttaggtcgttgggtaacg

SEQ ID NO: 360829 - DNA, 758 bp, Homo sapiens
  misc_feature: GZ8MTXP01DCRQX.21.4.A04.1.454.CMB.2.raw
  modified_base (218)..(218): a, c, t, g, unknown or other
  modified_base (271)..(271): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtggggganacgttggtccagcccgtgggacgggtccctgacgactctcctgtcgcagcctntgctatccaccttcagtcgaacccaacaactagtcggaaccgttcggggtccccgccgacgggcctacccggaaggggggaacgggggtccgttagggggacgggttcgggggtaccgggtaccggttaaagttaaaccggaaaagggaaaacgtacttaaaacgtaggtttaaaccgaaaggttaaaccgaaggtaaacgtaacccggggccggtacggttaccgtagggtaaggggaaaacgggtaacggtttaccaaacccgtatactaaacgaaagaagtatacggaaattaacgaaaagacttacaacgttggtaactcgtaagaacctaaagtacgaaacctacggaacccgtaaacggaaaaacccggcgggtaaaccgaccgggttaaccgttaagttaagtttagttagggttaaagggtaaacgttaaagaaaggttaggtaaggagttgggtcgggtaggttacgtgttggtaacg

SEQ ID NO: 360830 - DNA, 637 bp, Homo sapiens
  misc_feature: GZ8MTXP01CFJRM.21.4.A04.1.454.CMB.2.raw
  modified_base (178)..(178): a, c, t, g, unknown or other
  modified_base (272)..(272): a, c, t, g, unknown or other
  modified_base (296)..(296): a, c, t, g, unknown or other
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtntccagtgtgaggtgcagctgggtggagtcgtgggggatacgttggtccaggccgtgggacgggtccctgacgtactctcctggtcgcagcctcngcatccacttcagtcaccacaacngtggactcgggtccncgaggctacgagggagggctggagtggtcgcgtatacgaaggaacgctaacagtacaagtacaagaaatcggcgcgtctagggtaagaaacggtacggttaccaaaccgtataccgtacgaaaggagtagtacgaacttaaacgaaacgtaacttactaacgtagggttaactacgttagaacctaaagtacggaaactacggtacctaacggaaaacccggtgaaccgacggtaaccgttagttaagtttaagttggttaaggaacgaaacgttaaaagggttagttaagggattgggtaggtagggttacgtccgttggtaacg

SEQ ID NO: 360831 - DNA, 573 bp, Homo sapiens
  misc_feature: GZ8MTXP01E49N3.21.4.A04.1.454.CMB.2.raw
  modified_base (217)..(217): a, c, t, g, unknown or other
  modified_base (263)..(263): a, c, t, g, unknown or other
  modified_base (278)..(278): a, c, t, g, unknown or other
  modified_base (283)..(283): a, c, t, g, unknown or other
  modified_base (287)..(287): a, c, t, g, unknown or other
  modified_base (300)..(300): a, c, t, g, unknown or other
  modified_base (346)..(346): a, c, t, g, unknown or other
  modified_base (352)..(352): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagcctggacgggtccctgagactctctgtgcagcctntgcatcacttcagtnaccanaacntggactgggcccncaggcctcgaggggaggctgggagtgggcgcgtatacgaaaggaanctaaanagttacaaaggtacaaggaaataccgggcgtcgtctagggtagaaaagggtaggttacaaccatctacaaggagatagattaacaaagtaactacactaggtatctagacaaatgaaacagacctaagaaaacccgaggacgacggaacgtagttaattagttaggtaggtaanaaagaaaaggaggttaaggagttggtgggtgggagtcgttggtaacg

SEQ ID NO: 360832 - DNA, 692 bp, Homo sapiens
  misc_feature: GZ8MTXP01CUU2T.21.4.A04.1.454.CMB.2.raw
  modified_base (263)..(263): a, c, t, g, unknown or other
  modified_base (314)..(314): a, c, t, g, unknown or other
  modified_base (462)..(462): a, c, t, g, unknown or other
  modified_base (524)..(524): a, c, t, g, unknown or other
tcagtcgtcgctcgcacgaccggtgctcgatttagagtagtgatcaggggagctctgagagcggaagccccagccccagaattcccaggtgttttcatttggtgatcagcactgaacacagaggactcaccatggagtttgggctgagcttgggttttccttgttgttattttacaaggtgtccagtgtgaggtgcagcgtgggtggagtcgtgggggagtacttggtccagccgtgggacggtccctgagtactctcctgtncagcctctgctatccaccttcagtcgaaccacaacatggactcggggtccncgaggcctaccggagggggaggggctggggaggtgggtaccggaccgtaattaaccgaaaggaaacgtactaagagttaacaaagttaacaagaacgtaccgggcgtcgtacgtaggtacgaaaagggtcttacacctaattccgaanaaaggtagtagttagtaacttaccgaaaaagccttaacgtacttaggtaacttccggtaaanaaacgtaaagacgaaaccgacggtaaacccgaaacggaaaaccggcgtaaccggtacgggttaacgttaagttaagtttaggttagggttaaaggtaacgttaaaaacgaaaggggttggtaaggtagggttgggttaggggtaggttacggtcggttaacggtaacg

SEQ ID NO: 360833 - DNA, 668 bp, Homo sapiens
  misc_feature: GZ8MTXP01B23LE.21.4.A04.1.454.CMB.2.raw
  modified_base (216)..(216): a, c, t, g, unknown or other
  modified_base (263)..(263): a, c, t, g, unknown or other
  modified_base (304)..(304): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagcctggacgggtccctgagactctctgtgcagcctntgcatcaccttcagtcgaccacaacatggactggggtcccncgaggcctccgagggggagggctgggaggtgggtccggccgtaagtaacgaaaggaaacgctaaacgagttaacaagttaacaaggtaaactacgggacgcgtcgtagggtaagggaaaagggtaacggtttccaaacctagtctacgaaaggtagtaatgaaacttacgaaaaagtaactacaacgttaggtaatccgtaagaacctaaaatcgaaaacgacgtaccctaaggaaaaaacccggcgggaaacctaccggggtaaccgttaagttaagtttaagttagggtaaagggtaagaaaaccgaaaagggttaggttaagggagttaacgggtgggtacgggttagtccgtttaaggcg

SEQ ID NO: 360834 - DNA, 647 bp, Homo sapiens
  misc_feature: GZ8MTXP01CQZGQ.21.4.A04.1.454.CMB.2.raw
  modified_base (306)..(306): a, c, t, g, unknown or other
  modified_base (359)..(359): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagtacttggtccagccgtggagggtccctgagactctcctgtgcagcctctgctatcaccttcagtcaaccacaacatggactcggggtcccncaggcctcgagggggacgggctggaggtgggtcggccgtaatacgaaaggaanctaaacagttacaagtaacaagaacgtacggcgtcgtactaggtagaaaagggtacgtttccaaccgtatcctacaaagagtaatagaacttacaaaagtaactacaacgttggtaactcgtagaacctaaaagtcgaaaaccacggtaacccgtaaaggaaaaacccggaggaaacccgaccggggtaaccgttagttaattttaagttgggtaaacggtaagaaaacgaaaagggttaggtgggaaagttcgggttaggggtcggttaagtccgttaaggtaaccg

SEQ ID NO: 360835 - DNA, 738 bp, Homo sapiens
  misc_feature: GZ8MTXP01EPNBB.21.4.A04.1.454.CMB.2.raw
  modified_base (314)..(314): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacgttggtccaggcctgggacgggtccctgacgactctcctgtgcagcctctgcatccaccttcagtcgaaccaacaacagtcggactcggggtcccnccgaggcctaccggagggggaacggggcgtgggacggtgggggtccggaccgttaagttaaccgaaagggaaacgtactaaagtacgttaacgaagtaacaaggaagtaacgggcgtacgtcgtagggtaacgaaaagggtacgttacaacctatacctagaaaggtaagaattaggtaaacttaaccgaaaacgtaaacctactaaaccgttaggggttaaacttaccgttaagaaacctaaaagtaacggaaacctaacggtaacccgtaaacggaaaaacccggtaacgggaacccgtaaacggggtccgttaagtttaagttaaggtttaggtaacgggttaaacgaaaacgttaaaaagggttaggttaagggtagtttaagggtgggggtacggttaaggtccgttaagggtaaccgg

SEQ ID NO: 360836 - DNA, 808 bp, Homo sapiens
  misc_feature: GZ8MTXP01CAL2T.21.4.A04.1.454.CMB.2.raw
  modified_base (217)..(217): a, c, t, g, unknown or other
  modified_base (368)..(368): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttccttgttgttattttacaaggtgtccagtgtgaggtgcagctgggtggagtcgtggggganacgttggtccagccgtggacgggtccctgagactctcctgtcgcagtcctctgctatccaccttcagtcaccacaacagtggactggggtcccccgaggccgtaccgagggggaggcgtggaggtgggtccgacgtaatacgaaaggaacnctaaacagttaacaaagttaacaaggaactacgggcgtcgtacgtggtaaaggtaaagggtaacggttccaaccgtagtacctacgaaaggtaagtaagttacgtaatttaaccgaaaaaacggttaaccttaccgtaaaccgttaggggttaacttacccggtttaaagaaacccgtaaaaaagtttccggaaaaaccgttaacggaaaccccggttaaaaccggaaaaaaaaaccccgggggcggggtaaaaccccgtaaacccgggggtaaaccccggtttaaggtttttaaacggttttaaacgggtttaacggggttaaaggggtaaaaccggttaaaaaacggttaaaaaaggggttacggggtttaagggttaaaaggttcgggggttttagggggtaacgggggtttagtaaccgggtttgggttaaaccgg

SEQ ID NO: 360837 - DNA, 699 bp, Homo sapiens
  misc_feature: GZ8MTXP01C23K4.21.4.A04.1.454.CMB.2.raw
  modified_base (204)..(204): a, c, t, g, unknown or other
  modified_base (239)..(239): a, c, t, g, unknown or other
  modified_base (245)..(245): a, c, t, g, unknown or other
  modified_base (298)..(298): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanacgcccaccctctcctgcagctccagccagaatanccaganctacacatacgcctaggtacagcagaagcctggccaggcctccccaggttccncaatctatcgccgtcgggtaccccacgacgggcccacgtcggacacgtccccgagaaccgtacgggttccaggttcgggcgtagggttcggggtaccgtgggggaacctagggtacctttccgaaccttctacatactagttacggcaagacgtggaacgtccgttaggaaacgttacgtttcgacttaaggttagttaacgtttacgttagtaccgaagacgtaaggttagttacggtaaacgttcctaacccgttcgttacggttcccgggttaacgggaacccggttaaacgggggtaaaccgttaaaagggttaaacggaaaacgttaacggaaaaaccggttaaccgttaagggtacgggtccttacggacccttaacccgtaagttcgttaacgg

SEQ ID NO: 360838 - DNA, 493 bp, Homo sapiens
  misc_feature: GZ8MTXP01AJ5O0.21.4.A04.1.454.CMB.2.raw
  modified_base (201)..(201): a, c, t, g, unknown or other
  modified_base (291)..(291): a, c, t, g, unknown or other
  modified_base (310)..(310): a, c, t, g, unknown or other
  modified_base (368)..(368): a, c, t, g, unknown or other
  modified_base (433)..(433): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttcctnatctatgctgggtccccanagggccatggcatcccagacacggttcagtggcagtgggctgggacagacttcactcncatcattagcagactggagcctgaagattcgcagtgtattactgtcagcagtatggaattcactntgtcgttcggcaagggaccaaggtaagaaattgaaacgacgtgaggctgcactaattctg

SEQ ID NO: 360839 - DNA, 575 bp, Homo sapiens
  misc_feature: GZ8MTXP01A61N1.21.4.A04.1.454.CMB.2.raw
  modified_base (216)..(216): a, c, t, g, unknown or other
  modified_base (302)..(302): a, c, t, g, unknown or other
  modified_base (347)..(347): a, c, t, g, unknown or other
  modified_base (352)..(352): a, c, t, g, unknown or other
  modified_base (487)..(487): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggganacttggtccagcctggagggtccctgagactctcctgtgcagcctctgctatcaccttcagtcaccacaacatggactggggtccncgaggctacgagggagggctggagtggtcgcgtatacgaaggaanctaanagttacaagtaacaaggaatacgggcgcgtcgtaggtaggaaaggtagttcactagtctacaaagagatagaattacgaaaacgtactacactggtaatctagactaaatgaaacagaccgtaagaaaacccggnggaaccacgggccgttagttagtttagttcggtaagggtaagaagaaaggaggttaaggatgggttggacggttagtcgttggtaacg

SEQ ID NO: 360840 - DNA, 524 bp, Homo sapiens
  misc_feature: GZ8MTXP01CASIH.21.4.A04.1.454.CMB.2.raw
  modified_base (212)..(212): a, c, t, g, unknown or other
  modified_base (270)..(270): a, c, t, g, unknown or other
  modified_base (297)..(297): a, c, t, g, unknown or other
  modified_base (346)..(346): a, c, t, g, unknown or other
  modified_base (371)..(371): a, c, t, g, unknown or other
  modified_base (376)..(376): a, c, t, g, unknown or other
  modified_base (460)..(460): a, c, t, g, unknown or other
  modified_base (487)..(487): a, c, t, g, unknown or other
  modified_base (496)..(496): a, c, t, g, unknown or other
tcagtcgtcgctcgcacgaccggtgctcgatttagagtagtgatcagggagctctgagagcggagccccagccccagaattcccaggtgttttcatttggtgatcagcactgaacacagaggactcaccatggagtttgggctgagctgggtttccttgttgttatttacaaggtgtccagtgtgaggtgcagctggtggagtctggggganacttggtccagcctggagggtccctgagactctcctgtgcagcctctgcatcaccttnagtgaccacaacatggactggggtccncaggctcgagggagggctggagtgggtcgcgtatacgaaggaagctaanagttacaagtacaagaatacgggcncgtcnggtagaaagggagttcaccatctacaagagatgattacaaagactcactggtatctagacaaatgaacagacctagaaaaccgnggacacggcgtgttatattgtaggtanaacgaaagngtggatggtggtggttacgtcgttgtcg

SEQ ID NO: 360841 - DNA, 577 bp, Homo sapiens
  misc_feature: GZ8MTXP01EWE9O.21.4.A04.1.454.CMB.2.raw
  modified_base (203)..(203): a, c, t, g, unknown or other
  modified_base (297)..(297): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagagctaactacatacgcctggtaccagcagaacgcctggccaggcctcccaggttccnatctatcgctcgggtccccagacgggcccagtcggacactccccaagactaggttcaggtggctaggtcgggtctggggacagtccttcactctcatcattagcagacgtggacgtcgtagaagtattcgactagttgttattcgtgtcagtctagtagtaggtaacttctacttcgtcggttcggtaacggacgttaaaggggaaccttaaagggtaagaaacgttacggaaacgttacgtggtaggtaacgtaggaccttaccgtaagttcgttaacg

SEQ ID NO: 360842 - DNA, 622 bp, Homo sapiens
  misc_feature: GZ8MTXP01BS7B0.21.4.A04.1.454.CMB.2.raw
  modified_base (215)..(215): a, c, t, g, unknown or other
  modified_base (260)..(260): a, c, t, g, unknown or other
  modified_base (270)..(270): a, c, t, g, unknown or other
  modified_base (274)..(274): a, c, t, g, unknown or other
  modified_base (279)..(279): a, c, t, g, unknown or other
  modified_base (283)..(283): a, c, t, g, unknown or other
  modified_base (295)..(295): a, c, t, g, unknown or other
  modified_base (358)..(358): a, c, t, g, unknown or other
  modified_base (372)..(372): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacttggtccagcctggaggtccctgagactctcctgtgcagcctntgcatcactnagtnaccanaacntggactgggccncaggctccgaggggagggctgggagtgggtcgcgtatacgaaggaagctaagagtacaagtanaaggaatacgggcncgtctaggaggaaaggtacgttacaacctatactacgaagtagagtagattaccgaaaagtactacgtactaggtactcgtacgaaactaaagtacggaaaccaggaaacccgtaagggaaaaccccggagggaaccctacggggtaaccgttagggttaaatttaagttggtaaagggtaaacgaaacgaaaaagggttcggtaagggaagttgggttaggggtcggttaggtcgttaagggtaacccg

SEQ ID NO: 360843 - DNA, 843 bp, Homo sapiens
  misc_feature: GZ8MTXP01AWLSR.21.4.A04.1.454.CMB.2.raw
  modified_base (264)..(264): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggacgggtccctgagactctcctgtgcagcctngctatcaccttcagtcgaaccacaacagtggacgtcggggtcccgccgaggccctaccggagggggaagggggtcgtgggggacgggttcgggggtaccggtaccgtaaagttaaccgaaagggaaacgtacttaaacgagtttaacgaaacggttaacaaggaaacgtacccgggccggtaccgttacgttaggggtaaagggaaaaacggggttaacggtttcccaaaccgtaactttacccgaacgaaaagggtacggtaaatttggaaactttaaccgaaaaaacgttaacccttacaaaccgtttggttaaacttaccgttaacggaaccttaaaaagtacgggaaaacctaacgggtaaccccggttaaagggaaaaaaacccccggtaggggaaaccccgtaaacccggggggtaaccttttaagggtttaaacgtttttaacgggtttaacggggttaaacgggttaaaacggaaaaacggttaaaaaaggggttcggggttaaggggtaaaccgtttgggggttagggggttaaccgggttaacgtcccgggtttaagggttaaacccgg

SEQ ID NO: 360844 - DNA, 576 bp, Homo sapiens
  misc_feature: GZ8MTXP01ALRF7.21.4.A04.1.454.CMB.2.raw
  modified_base (200)..(200): a, c, t, g, unknown or other
  modified_base (290)..(290): a, c, t, g, unknown or other
  modified_base (307)..(307): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaanagccacctctcctgcagctccagccagaatatccagagctactacatagcctggtaccagcagagcctggccaggcctcccaggttcctnatctatgctgggcccangggccactggcatcccagacaggttcaggtgcaggtgggtctgggacagtacttcgactctacatcattagcagactggagtcctgaacgtatttcgactagttgtatttactggttcagtcgtagttacgtaggtaacgttctaccttcgttcggttccggttaaccgggaaccgaaagggggtaaaccccaaggggttaaagaaacgttacggaaaaccgttacgttaagggtgaaccgttaggcaacccgtaagttcgtttaaccg

SEQ ID NO: 360845 - DNA, 530 bp, Homo sapiens
  misc_feature: GZ8MTXP01CLC6Z.21.4.A04.1.454.CMB.2.raw
  modified_base (216)..(216): a, c, t, g, unknown or other
  modified_base (291)..(291): a, c, t, g, unknown or other
  modified_base (304)..(304): a, c, t, g, unknown or other
  modified_base (420)..(420): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggacgggtccctgagactctcctgtgcagcctctgctatccaccttcagtcgaccacaacntggactgggtccncaggctacgaggggaggctggagtggtcgacgtatacgaaggaagctaagagttacaaagtacaagaaatacgggacgcgtatggtagaaagggtagttcagtcatcctagaaganatgattacaaagactcacgtgtatctagacaaatgaacagctaagaaaccgtgaccaacggcttagtattgtggtagaagacaaagtgtggaatcggtgttgtaagcgtg

SEQ ID NO: 360846 - DNA, 738 bp, Homo sapiens
  misc_feature: GZ8MTXP01BC8PE.21.4.A04.1.454.CMB.2.raw
  modified_base (216)..(216): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctggtggagtcgtggggganacgttggtccagccgtggagggtccctgagtactctcctgtcgcagtcctctgctatccaccttcagtacgaaccaacaacagtggaccgtcggggtccccaccgacggcctaccggagggggaaggggccgtgggggaggttcggggtaccggaccgttaagttaaccgaaagggaaagtactaaacgtagttaacgaaagttaaccgaagtaacgtacgggcgtcgtacgtaggtaaggaaaacgggtacggttaccaaacccgtataccgtaacgaaaaggtagtaactagtaaacttaacaaaaacgttactcgtaacttggttaactccgtaaagacctaaaagtcgaaaccgtacggacccgtaaaacggaaaaacccggtacggaaccgaccccggggttaagttagtttaaacgtttaggttagggtaaaccgggtaaagaaaacgaaaaagggttggggtaaccggtaagtggggtttaggggtaccggttaacgtcgtttaagggtaacccg

SEQ ID NO: 360847 - DNA, 517 bp, Homo sapiens
  misc_feature: GZ8MTXP01C71XX.21.4.A04.1.454.CMB.2.raw
  modified_base (201)..(201): a, c, t, g, unknown or other
  modified_base (209)..(209): a, c, t, g, unknown or other
  modified_base (288)..(288): a, c, t, g, unknown or other
  modified_base (306)..(306): a, c, t, g, unknown or other
  modified_base (404)..(404): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctntcctgcagctcagccagaatatccagagctactacatagcctggtaccagcagaagcctggccaggctcccaggttccnatctatgctggtcccagngggcccagtggcatcccagaccaggttcagtggcagtgggtctggggacaggtacttcgactctcatcattagcagactggagcctagaagtattcgntaagtgttattactgtcagcagtataggtaacttctacctgtcgtcgttaacggcgaaagggaccaaggtaagaagttagaaacgatggtaggctaggcacctgttcttaacg

SEQ ID NO: 360848 - DNA, 652 bp, Homo sapiens
  misc_feature: GZ8MTXP01DEVCI.21.4.A04.1.454.CMB.2.raw
  modified_base (271)..(271): a, c, t, g, unknown or other
  modified_base (315)..(315): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggaatttgggctgagcttgggttttccttgttgttattttacaaggtgtcagtgtgaggtgcagcgtgggtggagtcgtgggggatacgttggtccaggccgtgggacgggtccctgacgactctcctgtcgcagcctntgctatccaccttcagtacaaccacaacagtggacgtcgggccncgaggctcggaggggagggcgtggaggtggcgacgtatacgaaaggaagctaacgtagtaacaagttaacaagtaaacgtacgggcgacgtcgtagggtaaggaaaacgggtacgttaccaaccgtatactaacgaaaggaagtaatagtaaacttaacgaaaacgtaacctacgtaacgttaggtaacttaccgtaagaactaaatacggaaacacgtaaccgaaacggaaaacccggtacggaaccgtacgggtaaccgttagttaacgttagttaggtaggtaagaaaacgaaaggaggtaaggtagttggtgggtggttacgtcgttgtaacg

SEQ ID NO: 360849 - DNA, 546 bp, Homo sapiens
  misc_feature: GZ8MTXP01A7NUK.21.4.A04.1.454.CMB.2.raw
  modified_base (262)..(262): a, c, t, g, unknown or other
  modified_base (274)..(274): a, c, t, g, unknown or other
  modified_base (300)..(300): a, c, t, g, unknown or other
  modified_base (352)..(352): a, c, t, g, unknown or other
  modified_base (470)..(470): a, c, t, g, unknown or other
  modified_base (515)..(515): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacttggtccagcctggagggtccctgagactctcctgtgcagcctntgcatcaccttnagtgaccacaacatggactcggtccncaggctccgaggggagggctggagtgggtcgcgtatacgaaggaagctaaanagttacaagtacaagaaatacggcgcgtctagtagaaaggagttcaaccgatctacaagagatagattacaaagactcactggaatctagacaaatcgaaacagacctagaaaaccgnggaaccacgggcctagttattagttgtaggtaacgaagaaaaggngtaaggatggtacgggtggttagtgttgtcg

SEQ ID NO: 360850 - DNA, 760 bp, Homo sapiens
  misc_feature: GZ8MTXP01DH7JW.21.4.A04.1.454.CMB.2.raw
  modified_base (265)..(265): a, c, t, g, unknown or other
  modified_base (308)..(308): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagccgtggagggtccctgagactctcctgtgcagcctntgcatcaccttcagtagaccaacaacatggacctcggggtccnccgagggcctaccggagggggaaggggcgtaggggacggttcgggggtccggtacccgttaattaaccggaaaagggaaacgtctaaaacgtaggtttaaccaaaggttaaccaagggaaactaaccggggcgtacgtcgtaggtacgggaaaagggtacggtttcaacccgtatcctagaaagagatagtaacttacgaaaaagtacctacaaccgtttggggtaacttacgtaacggaaacctaaaaagttacggaaaccgtaacggtaaaccccgttaacggaaaaaaaccccggggtggaaacccgtacccgggggtaaccgtttaaggttaaactttaaggtttagggttaaaggggttaaacgaaaacggttaaaaaagggttgggtttaagggaaaggtttggggttgggggttaaggttacggtaacgtttaacgggtaaaccg

SEQ ID NO: 360851 - DNA, 584 bp, Homo sapiens
  misc_feature: GZ8MTXP01D000W.21.4.A04.1.454.CMB.2.raw
  modified_base (300)..(300): a, c, t, g, unknown or other
  modified_base (321)..(321): a, c, t, g, unknown or other
  modified_base (342)..(342): a, c, t, g, unknown or other
  modified_base (375)..(375): a, c, t, g, unknown or other
  modified_base (409)..(409): a, c, t, g, unknown or other
  modified_base (473)..(473): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtgaccacaacatggactgggtccncaggctcgagggagggctggngtggtcgcgtatacaaggaanctaacagttacaagtacaagaatacggcgcgtntagtagaaaggaggttcaaccgatctacaaaganatgattacaaaagactacacttggtaactctagactaaatcgaaacagaacctagaaaacccgngggaaccacggggtccgttgttaatttagtttgggtaaggttaagaaaacgttaaaaaggttaggttgggtaaattgggttacggggtaggttaaggtcgttggttaacgg

SEQ ID NO: 360852 - DNA, 698 bp, Homo sapiens
  misc_feature: GZ8MTXP01BZ2G8.21.4.A04.1.454.CMB.2.raw
  modified_base (309)..(309): a, c, t, g, unknown or other
  modified_base (361)..(361): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggacgggtccctgagacctctcctgtgcagcctctgcatcaccttcagtcgaccacaacagtggactgggtcccncgaggcctcgaggggagggctgggagtggtccgaccgtaatacgaaaggaanctaaacagttacaaagtacaagaacgtacgggcgcgtacgtaggtaacggaaaagggtacgttccaaaccgtatacctaagaaaggaagtataggtaaacttaacgaaaaagtaaccttacgaacgttagggttaacttccgtaagaaacctaaaagttacgaaaacccgtacggtaaacccctaaaggggaaaaaaccccggaggggaaacccgtaaccggggtaacccgtttagttaaagttttacgttagggttaaacgggttaaagaaaacgttaaaaaggttgggttaagggtagttggggttcggggttagggttagtcgttaaggtaacg

SEQ ID NO: 360853 - DNA, 578 bp, Homo sapiens
  misc_feature: GZ8MTXP01EZVQV.21.4.A04.1.454.CMB.2.raw
  modified_base (216)..(216): a, c, t, g, unknown or other
  modified_base (254)..(254): a, c, t, g, unknown or other
  modified_base (261)..(261): a, c, t, g, unknown or other
  modified_base (304)..(304): a, c, t, g, unknown or other
  modified_base (362)..(362): a, c, t, g, unknown or other
  modified_base (387)..(387): a, c, t, g, unknown or other
  modified_base (538)..(538): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggaggtccctgagactctcctgtncagcctntgctatcaccttcagtgacccacaacatggactcggggtcccnccgaggctaccgagggggacggggctgggagtggggtcggccgttataacgaaggaanctaacagttacaagtacaaggaaanacggcgcgtcgtaggtagaaagggtagttcaccgatacgacaagagatgatacaaagactacactggtatctgacaaatgaacagaccgtagaaaacccgaggaaccgacggtcgtagttaagttagttggtaggtaagaacgaaaaaggnggttaagggagttggtgggtagggttaactcggttgtaag

SEQ ID NO: 360854 - DNA, 555 bp, Homo sapiens
  misc_feature: GZ8MTXP01DVLBH.21.4.A04.1.454.CMB.2.raw
  modified_base (300)..(300): a, c, t, g, unknown or other
  modified_base (344)..(344): a, c, t, g, unknown or other
  modified_base (349)..(349): a, c, t, g, unknown or other
  modified_base (478)..(478): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggagggtccctgagactctcctgtgcagcctctgcatcaccttcagtgaccacaacatggactggggtccncaggctccgagggagggctggagtgggtcgcgtatacaaggaanctaanagtacaagtacaagaatacgggcgcgtctggtagaaaggagttcaacctatctacaaagagatagaattacaaaagactacacttggtaactctagactaaaatcgaaactagaacctaggaaaaccgnggaaccgacgggtcgttagttatttagttgtagggtaacaagaaaagnggtggatgggtggtcggatcgttgtaacg

SEQ ID NO: 360855 - DNA, 784 bp, Homo sapiens
  misc_feature: GZ8MTXP01C4M61.21.4.A04.1.454.CMB.2.raw
  modified_base (730)..(730): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggtttttccttgttgttattttacaaggtgtccagtgtgaggtgcagcgtggtggagtcgtgggggagtacgttggtccagcccgtgggacgggtccctgagtactctcctgtgcagtcctctgctactccaccttcagtcgaacccaacaacagtcgggaccgtcggggtccccgacccgagggccgtaccggaagggggtaacgggggccgtggggaggttcgggggtaccggtaccgttaaagttaacgaaaagggtaaaacggtaccttaaaacgtaagtttaaaccgaaaacggttaaccgtaaggaaacgtttaacccgggggcccggtacggttacgtacggggttaaagggaaaaacggggtaaccgggtttacccaaaccccgtagttaacccgtaacgaaaaggtaagtacttaaggtaaacctttaacgaaaaaacgtaccttactaccgttaggttaacttacgtacgtaaaacaaagtaaccgaaacgtaacgaacccgttaaacggaaaacccggaggtaaccgtacgggtaaccgttattaagtttaggttggtaagggtaaanaaacgttaaaggttggtgggtaagtcgggttaggtggttactcggttggtaacg

SEQ ID NO: 360856 - DNA, 848 bp, Homo sapiens
  misc_feature: GZ8MTXP01DSOJU.21.4.A04.1.454.CMB.2.raw
  modified_base (271)..(271): a, c, t, g, unknown or other
  modified_base (284)..(284): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggatacttggtccagccgtgggacggtccctgacgtacctctcctgtcgcagtcctntgctatcaccttnagtacgaccaaacaaccgagttcggaaccgttcgggggtccccaccgtacggggtcccgtaccgggaaaggggggtaacgggggtccggttagggggtaacgggttcgggggttacccgggtaaccggtttaaagtttaaaaccggaaaacggggtaaaacgtaccttaaaacggttaaggtttaaaccgaaagggttaaaccgtaagggaaacgtttacccgggaccgggtacgtttaccgtaggggttaaagggaaaaacgggtacggtttaccaaccgtaagtaccttaacgaaaaggtaaggtaattaaggtaaacttaacgaaaaaacgtaacctttaacgaacgtttagggttaactacgtaacggaaactaaaacgtaacgaaaccgtaacggaaacccgtaaacgggtaaaaacccggtaggaacccggaaccgggttaaccgttaagtttaaacgtttaacgttagggttaaacgggtaagttaaaaacgttaaagggttaaggggtgtaaaggttcgggtttaggggtacgggttaggtccgttgggttaaccg

SEQ ID NO: 360857 - DNA, 687 bp, Homo sapiens
  misc_feature: GZ8MTXP01BMCXM.21.4.A04.1.454.CMB.2.raw
  modified_base (309)..(309): a, c, t, g, unknown or other
  modified_base (623)..(623): a, c, t, g, unknown or other
  modified_base (639)..(639): a, c, t, g, unknown or other
  modified_base (675)..(675): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagcctggagggtccctgagactctcctgtgcagcctctgctatcaccttcagtcgaccacaacagtggaccgtggggtcccnccgaggcctaccggagggggacggggctgggaggtggggtccgaccgtaatacgaaaggaagactaaacgagttaacaagttaacaaggaaactaccgggcgtcgttacgtggtaaggaaaagggtacggtttccaaccgtatacgtacaaaggtagattgtaattaacgaaaagtacctacgtaacttagggtaacttcgtagaacctaaaagtacgaaacgtacggaaacccgtaaacggaaaaacccggacggaacccgtaaccggggtaaccgtttaagttaacgttttaggttagggtaacgggttaanaaaacggttaaaaggnggtttaagggagttggggttacgggtaggttaccgngtttcggtaacg

SEQ ID NO: 360858 - DNA, 603 bp, Homo sapiens
  misc_feature: GZ8MTXP01BMTWL.21.4.A04.1.454.CMB.2.raw
  modified_base (285)..(285): a, c, t, g, unknown or other
  modified_base (305)..(305): a, c, t, g, unknown or other
  modified_base (372)..(372): a, c, t, g, unknown or other
  modified_base (559)..(559): a, c, t, g, unknown or other
  modified_base (570)..(570): a, c, t, g, unknown or other
  modified_base (590)..(590): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaggtgtccagtgtgagtgcagctggtggagtcgtggggggagacttggtccagccgtggagggtcccctgagactctcctgtgcagcctctgcattcaccttcagtcacccanaacagtggacgtgggtcccnccgaggcctaccggaaggggaggggctgggaggtcggggtcgccgtattacgaaggaacgctaaagngttacagtaaacagaacgtacggcgacgtcgtaggtaggaaagggtacggttaccactagttacacgaaagagatagtattaacaaaacgactacgacttagtactcgtagaacaaagtacgaaacacgtaccgaacgaaaccgacgggactacggggcctaagttaatttagtaggttaggtaaanaacgaaaaggngttggaagtcgtggtggtancgtaagttgaacg

SEQ ID NO: 360859 - DNA, 637 bp, Homo sapiens
  misc_feature: GZ8MTXP01DPT8F.21.4.A04.1.454.CMB.2.raw
  modified_base (202)..(202): a, c, t, g, unknown or other
  modified_base (309)..(309): a, c, t, g, unknown or other
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggccaccctgtctttgtctccgaaggggaanacgccaccctctcctgcagctccagaccagaatactccagacgtactaactacatacgcctaggtaccagacaagaacgccgtcggaccaggcctcccgaggttccncatctagtcgccgtacgggtacccagacgggccacgtcggcacgtcccagacgtacggttcaggtggctagggtcgggtctggggactaggtaccttcacgttctacgacttactaattacgacgaaggtacgtagggactaccgttaagaacgttgttccgagtaggttacttaagttcgtagtacgaagtcgtaagttagtaggtaacgttcctaccgttcgtcggttccggtaacggaaccggttaaagggtaccgttaaagggtaaataaaggttacgaaacgttacgtgggtacgcgtacgaccttacgtaacttcgttaacg

SEQ ID NO: 360860 - DNA, 644 bp, Homo sapiens
  misc_feature: GZ8MTXP01EX15S.21.4.A04.1.454.CMB.2.raw
  modified_base (256)..(256): a, c, t, g, unknown or other
  modified_base (279)..(279): a, c, t, g, unknown or other
  modified_base (288)..(288): a, c, t, g, unknown or other
  modified_base (302)..(302): a, c, t, g, unknown or other
  modified_base (350)..(350): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggacgggtccctgagactctcctgtncagcctctgctatcacttcagtnaccacaacngtggactgggtccncgagctacgaggggaggctgggagtgggtcgccgtatacgaaaggaanctaaagagttaacgaagtaacaaggaacgtacgggcgtcgtacgtaggtaggaaaagggtacgttacaaccgtatctaacaaaggagatagaacttaacgaaaagtaacctctaaccgttaggttaattccgtagaaccaaaagtcggaaacctaacgacccgtaaaggaaaacccggcggaaaccgtaccgggtccgttaagtttaaagtttagttagggtaagggtaaacgaaagaaaaggttgggtaaggtaagttggggttacgggtagggttaccgtcgtttggaaccg

SEQ ID NO: 360861 - DNA, 597 bp, Homo sapiens
  misc_feature: GZ8MTXP01B42XT.21.4.A04.1.454.CMB.2.raw
  modified_base (201)..(201): a, c, t, g, unknown or other
  modified_base (235)..(235): a, c, t, g, unknown or other
  modified_base (295)..(295): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanacgccaccctctcctgcagctccagccagaatancaagagctactacatacgcctggtaccagcagacgcctggccaggcctcccgaggttccnatctatgccgtcgggtccccagcgggcccacgtcggacactcccagaccgtacggttcaggtggctaggtgggtctggggacagtacttcactctcatcattagacagacgtggacgtcgtagaacgtacttcgctaagttcgttattacgtgtacagtactagtagtaggtaacgttcctaccgttcgtcggttcggttaaccggaaccggaaaggggtaacccgttaaagggtaaacgtaaagttaacggaaaccgttaacggtggtaggcgtacggaccttaccgtaacttcgttaacg

SEQ ID NO: 360862 - DNA, 607 bp, Homo sapiens
  misc_feature: GZ8MTXP01DKT0W.21.4.A04.1.454.CMB.2.raw
  modified_base (376)..(376): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtgaccacaacatggactgggtccgccaggctccgagggggagggctggagtgggcgcgtatacgaagaagctaacagttacaagtacaagaaatacggcncgtctagtaggaaaggacgttcaccagtctacaagagatagaattacaaagaacctctaactaggtactactagaactaaaatcgaaacagaccctaaggaaaaacccggtaggaccgaaccgggtaacgttagttaaagtttaacgttaggttaagggaagttaaaacggaaaaaggttagggttaagggaagttggggtcggggtagggttacgcgttaagggtaaccg

SEQ ID NO: 360863 - DNA, 538 bp, Homo sapiens
  misc_feature: GZ8MTXP01DPKP6.21.4.A04.1.454.CMB.2.raw
  modified_base (215)..(215): a, c, t, g, unknown or other
  modified_base (262)..(262): a, c, t, g, unknown or other
  modified_base (300)..(300): a, c, t, g, unknown or other
  modified_base (475)..(475): a, c, t, g, unknown or other
  modified_base (479)..(479): a, c, t, g, unknown or other
  modified_base (500)..(500): a, c, t, g, unknown or other
  modified_base (509)..(509): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctgggtggagtcgtggggganacttggtccagcctggacgggtccctgagactctcctgtgcagcctntgcatcaccttcagtgaccacaacatggactgggtccncaggctcgagggagggctggagtgggtcgcgtatacgaaggaagctaagagttaacaagtacaagaaatacgggcgtcgtctaggtagaaaggtaagttcaaccatctacaaagagatagattacaaaagactacactggtaatctagacaaatgaaacagacctagaaaaccgngacncggctagattattgtagtaanaacgaaagngtggatggtggtacggttagcgttgtaag

SEQ ID NO: 360864 - DNA, 672 bp, Homo sapiens
  misc_feature: GZ8MTXP01AY9QX.21.4.A04.1.454.CMB.2.raw
  modified_base (215)..(215): a, c, t, g, unknown or other
  modified_base (305)..(305): a, c, t, g, unknown or other
  modified_base (370)..(370): a, c, t, g, unknown or other
  modified_base (627)..(627): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacttggtccagcctgggacgggtccctgagactctcctgtgcagcctctgcatccaccttcagtcgaccacaacagtggactggggtccncaggcctaccgagggggagggctgggaggtgggtcgacgtataacgaaggaaagctaacgagtanaagtacaagaatacgggcgtcgtacgtggtagaaacggtacgttcaaccgtattactacgaaaggagtacttagaactttacgaaaacgtaaccttcgtaaccgtttagggtaacttacgttacggaaaccttaaaaagtccgaaaaccgacggttaacccgaaacgggaaaaaccccggtaggtaaaccccgaaccggggtaaccgttagttaagttaaggttggtaaacgggttaagaaaaccgttaaaaagggnggttaagggaagttgggtacgggtaggttagtcgttaaggtaacg

SEQ ID NO: 360865 - DNA, 647 bp, Homo sapiens
  misc_feature: GZ8MTXP01DDJ43.21.4.A04.1.454.CMB.2.raw
  modified_base (219)..(219): a, c, t, g, unknown or other
  modified_base (262)..(262): a, c, t, g, unknown or other
  modified_base (269)..(269): a, c, t, g, unknown or other
  modified_base (280)..(280): a, c, t, g, unknown or other
  modified_base (284)..(284): a, c, t, g, unknown or other
  modified_base (289)..(289): a, c, t, g, unknown or other
  modified_base (293)..(293): a, c, t, g, unknown or other
  modified_base (306)..(306): a, c, t, g, unknown or other
  modified_base (352)..(352): a, c, t, g, unknown or other
  modified_base (357)..(357): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtggggganacgttggtccagccgtgggacgggtccctgagactctcctgtncagcctntgcatcacctnagtnaccanaacntggactcgggccncgaggctcgagggagggctggagtgggtcgcgtatacgaaaggaanctaanagtacaagtaacaagaactacgggcgtcgtagtaggtaggaaaacgggagttccaacctatctacgaaaggatagtagtaacttacaaaagtaacctctaacgttggttaactcgtagaactaaatcggaaacacggtaacccgtaaacggaaaacccgggaggaacccgtaacggggttaaccgttaagttaaacgtttagttagggttaaaggaaagttaaacgttaaaaggttagggtaagggaagtttcggggtaggggttaggttacggtccgttgggtaaccgg

SEQ ID NO: 360866 - DNA, 595 bp, Homo sapiens
  misc_feature: GZ8MTXP01EE8K8.21.4.A04.1.454.CMB.2.raw
  modified_base (200)..(200): a, c, t, g, unknown or other
  modified_base (208)..(208): a, c, t, g, unknown or other
  modified_base (230)..(230): a, c, t, g, unknown or other
  modified_base (236)..(236): a, c, t, g, unknown or other
  modified_base (287)..(287): a, c, t, g, unknown or other
  modified_base (309)..(309): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaangccacctntcctgcagctccagccagaatnccaganctatacatacgcctggtacagcagacgcctggccaggcctcccaggttccnatctatgctcgggtccccacgngggccctagtcggacacgtccagacctggttcaggtggcaggtcgggtctggggacagtacttcactcacatcattagacagacgtggacgtctagaagtattccgatagttagttacttacgtgtacagactagtagttacgggtaaacgtttcctacccgttcgtcgggttccggttaaccgggaccgttaaacggggtaaccgttaaagggtaagtaaaacggttacggaaaaccggttagttcgggtacgtccgttcggaccttacctcgttcgtttaaccg

SEQ ID NO: 360867 - DNA, 627 bp, Homo sapiens
  misc_feature: GZ8MTXP01D9HLP.21.4.A04.1.454.CMB.2.raw
  modified_base (265)..(265): a, c, t, g, unknown or other
  modified_base (272)..(272): a, c, t, g, unknown or other
  modified_base (285)..(285): a, c, t, g, unknown or other
  modified_base (299)..(299): a, c, t, g, unknown or other
  modified_base (376)..(376): a, c, t, g, unknown or other
  modified_base (478)..(478): a, c, t, g, unknown or other
  modified_base (494)..(494): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagtcttgggttttccttgttgttattttacaaggtgtccagtgtggaggtgcagcgtgggtggagtcgtgggggagtacttggtccagccgtgggacgggtccctgacgtactctcctgtncagcctntgctatcaccttnagtcgaccacaacngtcggactcggggtccccacgaggcctacggagggggaagggctgggaggtgggtccgaccgtatacgaaacggaanactaatgtaacaaagtacaaggtaactacgggcgtcgtactgggtaacggaaaaggtacgttacaacctatctacgaaagagtatagtataacaaagaactnacgttagtactcgtanacgtaaatcgaactacgtacccgtaaacggaaaaccggcgaacgtccggtaacttagttaagttagttgaacggtaagaaagaaaggttggtaaggtagttcggtaggggtacgttaggtcgttaaggtaacg

SEQ ID NO: 360868 - DNA, 735 bp, Homo sapiens
  misc_feature: GZ8MTXP01ATSQV.21.4.A04.1.454.CMB.2.raw
tcagtcgtcgctcgcacgaccggtgctcgatttagagtagtgatcaggggagccctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtccctgagactctcctgtcgcagcctctgctacttccacccttcagtcgaacccaacaacagtcgggaccgtcggggtccccaccgacgggcctacccggaaggggggaacgggggtccgtagggggacggttggggggtccggtacccggttaattaaacggaaaggggtaaaacgaccttaaaacgaggtttaaaccaggtaaacaaggaacgtaccggggccgtacggttacgtagggtaagggaaacgggttaacgggttaccacctaagttcccgtaagaaaggtacgtaagttacggtaaattaaccgaaaagtaaccttacaacgttgtaacttcgtaggtaaccaaagtacgaaacgacggtaacccaaacgggaaaacccgaggtaccgaacgggtccgtaaggttaactttaggtaggttaggtaaacgaagaaaagggttgttaggggtaattgggtaagggttggagttcgtggttaacgaacg

SEQ ID NO: 360869 - DNA, 573 bp, Homo sapiens
  misc_feature: GZ8MTXP01EE71M.21.4.A04.1.454.CMB.2.raw
  modified_base (261)..(261): a, c, t, g, unknown or other
  modified_base (283)..(283): a, c, t, g, unknown or other
  modified_base (287)..(287): a, c, t, g, unknown or other
  modified_base (300)..(300): a, c, t, g, unknown or other
  modified_base (342)..(342): a, c, t, g, unknown or other
  modified_base (368)..(368): a, c, t, g, unknown or other
  modified_base (372)..(372): a, c, t, g, unknown or other
  modified_base (382)..(382): a, c, t, g, unknown or other
  modified_base (395)..(395): a, c, t, g, unknown or other
  modified_base (473)..(473): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggacgggtccctgagactctctgtgcagcctntgctatcacttcagtcgaccanaacntggactgggtccncaggctcgaggggaggctggagtggcgcgtatacgaaggaanctaagagtacaagtacaagatacggncgtntgagaaaggngttcaacatctanaaagagatagattacaaaagtactagactggttaatcgtagaacaaaatcgaaactagaccctaaggaaaaacccggnggaaccgtacggtaacgttagttaagttagttaggtaaaggtaaacgaaagaaaaggttaggtgggacgttgggtacgggtggttagtcgttaagtaacg

SEQ ID NO: 360870 - DNA, 658 bp, Homo sapiens
  misc_feature: GZ8MTXP01DCTXN.21.4.A04.1.454.CMB.2.raw
  modified_base (203)..(203): a, c, t, g, unknown or other
  modified_base (235)..(235): a, c, t, g, unknown or other
  modified_base (242)..(242): a, c, t, g, unknown or other
  modified_base (249)..(249): a, c, t, g, unknown or other
  modified_base (298)..(298): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaaggggaaancgccaccctctcctgcagctccagccagaatntccaganctactanatacgcctggtaccagcaagacgcctggccaggcctcccgtaggttccnatctatcgactcgggtccccagacgggcccagtcggctactcccgagaccgtaggttcaggtggcagggtggtctgggacctagtacttcacgtctacatctattacgcacgacctggacgtaccgttagtaacgtacgtttccgacgtaggttacttaagtttaccgttaggttaccgaagtacgtaaggttaagttacggttaaaacgtttcctaccgtttacgttcggttaccgggtttaaccgggaaccggttaaaaggggtaccccgttaaaagggtaaaccgtaaagttaaacggttaaaccgttaacggttaaggtacggtaactacgggtacaccgtaacgtttccttaacg

SEQ ID NO: 360871 - DNA, 611 bp, Homo sapiens
  misc_feature: GZ8MTXP01AQH03.21.4.A04.1.454.CMB.2.raw
  modified_base (201)..(201): a, c, t, g, unknown or other
  modified_base (241)..(241): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccaccctgtctttgtctccgaggggaaancgcccaccctctcctgcagctccagccagaatatccaganctactacatagctggaccagcagaagcctggccaggcctcccgaggttcctcatctatcgctcgggccccagacgggcccacgtggcactcccgagaccgtaggttcaggtggctagggtcgggtctggggactacggactttccacttctacgtactacattaaggctaaggtaccgttgggaacgtcctaggtaaagtacgtttcgacgtaggttagttacgttaacgtgttacacggtactaagtagtacggtaaacgttctaccttccgtggttccggttccggaacgttaacgggaaccgttaaagggtaacgtaaaagttggaaaaccgttacgtaaggtggtctacggcaccgtaattcgtcg

SEQ ID NO: 360872 - DNA, 670 bp, Homo sapiens
  misc_feature: GZ8MTXP01ASB8A.21.4.A04.1.454.CMB.2.raw
  modified_base (216)..(216): a, c, t, g, unknown or other
  modified_base (314)..(314): a, c, t, g, unknown or other
  modified_base (452)..(452): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagcctggacgggtccctgagactctcctgtgcagcctctgctatccaccttcagtcgaacccacaacagtcggaccgtggggtccccnccgaggcctaccgagggggagggctgggaggtggggtcgaccgtaattaacgaaaggaaagctaaagagttaacaagtaacaagaacgtacgggctcgtcgtaggaagaaaagggtacgttcaaccgtataccgtaanaaaggaagtatagaattaacgaaaagtaactactaacttggtaacttacgtagaacctaaaagtacgaaacgtaccgaaccgtaaacggaaaaccggacggaaaccgacggggtccttaaggttaaagtttagttgggtaaagggtaaacgaaacgttaaaaaagggttgggttaagggtagttaagggttcggggtagggttagtcgttaaggtaag

SEQ ID NO: 360873 - DNA, 659 bp, Homo sapiens
  misc_feature: GZ8MTXP01BY88D.21.4.A04.1.454.CMB.2.raw
  modified_base (201)..(201): a, c, t, g, unknown or other
  modified_base (235)..(235): a, c, t, g, unknown or other
  modified_base (294)..(294): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcaccctgtctttgctccgaaggggaancgccaccctctcctgcagctccagccaagaatanccagagctactacatacgcctaggaccagcagacgcctggccaggctcccgaggttccnatctatgctcgggtcccacgacgggcccacgtggacctactcccgaagaccgtacggttcaggtcggccgtagggtcggggtcgtaacggggactaggtaccttcgaaccttctacgtataccgtaagttacgcgagtacgttggaacgtccgtaagtaacgtactttacgacgttaagttaggttaactttacgtaggtacctaggtaccgtaaggttagtacggtaacgtttcctaccgttcgttcggttccggttaacgggaacccggaaaggggtaacccgaaagggtaaacgtaaacgttaacggaaaacgttacgtaaggtacggaacgtacggaccttaccgtaacgttcgttaaccg

SEQ ID NO: 360874 - DNA, 622 bp, Homo sapiens
  misc_feature: GZ8MTXP01A5EYC.21.4.A04.1.454.CMB.2.raw
  modified_base (263)..(263): a, c, t, g, unknown or other
  modified_base (302)..(302): a, c, t, g, unknown or other
  modified_base (356)..(356): a, c, t, g, unknown or other
  modified_base (490)..(490): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagccgtggacgggtccctgagactctcctgtgcagcctntgctatcaccttcagtgaccacaacatggactgggtccnccaggctcgaggggagggctgggagtgggtcgcgtagtacgaacggaagctaanagttacaaagtacgaagaaataccgggcgtacgtcgtaggtagtaaaagggtacggttccaacctattcacgaaaggtaagattgaattaacgaaaagtacctacgacttaggggtactcgtacgaactaaagngaaacccagtacccgtaaggaaaaaaccccgggaggtaaccgaccgggtcgttaagttagttagttaggtaaggaagttaaacgaaaggttaggtaaggtagtgggtgggtacggttgtcgttaaggtaacg

SEQ ID NO: 360875 - DNA, 550 bp, Homo sapiens
  misc_feature: GZ8MTXP01DM8O1.21.4.A04.1.454.CMB.2.raw
  modified_base (203)..(203): a, c, t, g, unknown or other
  modified_base (290)..(290): a, c, t, g, unknown or other
  modified_base (376)..(376): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagagctggccaggctcccaggttccnatctatgctggtcccagagggcccagtggcactcccagaccaggttcagtggcaggtcggggtctggggactaggaccttcacctntcatcctattagcagacgtaggacgtcctagaagtatttcgctagttgttatttaacgtgttacaggtcagtatggtaaatctactcgtgtcgttcggccgttaagggaccgaaaggtagaacttaagaaacggttaacgtggtacggtctcggaccttacctaagttccgttg

SEQ ID NO: 360876 - DNA, 541 bp, Homo sapiens
  misc_feature: GZ8MTXP01AKASF.21.4.A04.1.454.CMB.2.raw
  modified_base (215)..(215): a, c, t, g, unknown or other
  modified_base (272)..(272): a, c, t, g, unknown or other
  modified_base (276)..(276): a, c, t, g, unknown or other
  modified_base (347)..(347): a, c, t, g, unknown or other
  modified_base (352)..(352): a, c, t, g, unknown or other
  modified_base (377)..(377): a, c, t, g, unknown or other
  modified_base (432)..(432): a, c, t, g, unknown or other
  modified_base (503)..(503): a, c, t, g, unknown or other
  modified_base (513)..(513): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacttggtccagcctggaggtccctgagactctcctgtgcagcctctgcatcaccttnagtnaccacaacatggactgggtccgcaggctccgaggggaaggggctggagtgggtcgccgtatacgaaggaanctaanagttacaagtacaagaatacgggcncgtctagtaggaaaagggagttcaaccatctacaagagatgattacaaagaactnactaggtatctgacaaatgaaacagacctagaaaaccgaggaccagggtcctgttattagttgtaggtaanaacgaaaagngtggatggtgggngttagcgttgtaacg

SEQ ID NO: 360877 - DNA, 619 bp, Homo sapiens
  misc_feature: GZ8MTXP01DL9R7.21.4.A04.1.454.CMB.2.raw
  modified_base (262)..(262): a, c, t, g, unknown or other
  modified_base (288)..(288): a, c, t, g, unknown or other
  modified_base (302)..(302): a, c, t, g, unknown or other
  modified_base (353)..(353): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggtttccttgttgttatttacaaggtgtccagtgtgaggtgcagctggtggagtcgtgggggagtacttggtccagcctgggacgggtccctgagactctcctgtgcagcctntgcattcaccttcagtgaccacaacngtggactgggtccnccaggctccgagggaggggctgggagtgggtcggccgtatacgaaggaacnctaacgagttacagtaacagaagtacgggcgacgtctagtagaaagggtacggttacacatacgtacaaggaagatagtaattacgaaagtaactactaactgtaacttactaggaacaaatacgaaaccgacgacccgtaaacggaaaacccggtaggaaaccgtaccgggtaccggttaagttagtttaaggttggttaggttaaacgaacgaaaaaggttggttaaggtaagtgggtgggtggtagttcgtaagttcggtaac

SEQ ID NO: 360878 - DNA, 772 bp, Homo sapiens
  misc_feature: GZ8MTXP01DLFTJ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtggaggtgcagctgggtggagtcgtggggggatacgttggtccagccgtgggacgggtccctgacgactctcctggtcgcacgcctctgctatccaccttcagtcgaacccaacaacagtcggaccgtcggggtccccgacgacgggcctaccggaaggggggaacgggggtcgtgggggacgggttcgggggtccggtacccggttaaagttaaccggaaaagggtaaacgtactaaaacgtaacggtttaaaccgaaaaggttaaccaaggtaaacgttacccggggaccggtccggttacgttagggttaaacgggaaaacgggtaacgtttaccaaacctagttcctaaacgaaagaaggtaacttggtaaacttaaacgaaaactaaaccttcgtaaacgtttgggtaacttctaacggaaactaaaagttacggaaaccacggtaacccgtaaacgggaaaaaacccgggtcggaaccgtaccgggtaacggtttagttaaacgtttaggttagtaaaggggtaacaaaacgttaaagggttgtaagggtaatggggtagggtaggacgtcgttggaacg

SEQ ID NO: 360879 - DNA, 663 bp, Homo sapiens
  misc_feature: GZ8MTXP01DAWM8.21.4.A04.1.454.CMB.2.raw
  modified_base (307)..(307): a, c, t, g, unknown or other
  modified_base (421)..(421): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcgtgggggatacgttggtccagccgtggaggtccctgagactctcctgtgcagcctctgctatccaccttcagtcgaccacaacatggactcgggtccncgaggctcgagggaggctggagtggtcgcgtatacgaacgaagctaagagtacaagtacaagaatacgggcgcgtactaggtagaaagggtacgttcaaccatctaacaaaganatagaacttaacaaaacgtactcgtaacttgggtaactaccgtagaacctaaaagtcgaaaccacggtaaaccctaaaggaaaaaacccggcgggtaaaacccgccggggtaacccggtttaaggttaaacgttttaagttagggttaaagggtaaaacggttaaaacgttaaaaagggttggttaaacggggtatttaacgggggttgggttagggttaagtccgttaagggtaaacccgg

SEQ ID NO: 360880 - DNA, 611 bp, Homo sapiens
  misc_feature: GZ8MTXP01BZBYO.21.4.A04.1.454.CMB.2.raw
  modified_base (216)..(216): a, c, t, g, unknown or other
  modified_base (299)..(299): a, c, t, g, unknown or other
  modified_base (317)..(317): a, c, t, g, unknown or other
  modified_base (373)..(373): a, c, t, g, unknown or other
  modified_base (379)..(379): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttgggtccaggcccgtgggacgggtccctgagactctcctgtgcagcctctgctattcaccttcagtcgaacccacaaacngtcggactcggggtcccnccgaggcctaccggagggggagggctgggaggtggggtcgcgtatacgaaggaacnctaaangttacagtaacagaacgtcgggcgcgtactaggtagggaaaagggtacgttccactatctacgaaagagtatagtaacttacaaaagacctcgaacttagtaacttcgtagaaccaaagtagaaaccacgacctaaaggaaaccgtggaaccaccgggtcgtaagttattagttggagtaaaggaacaaaaggttggttaggaatgggtaaggtggtattcgtgttcgaacg

SEQ ID NO: 360881 - DNA, 653 bp, Homo sapiens
  misc_feature: GZ8MTXP01AUOSW.21.4.A04.1.454.CMB.2.raw
  modified_base (264)..(264): a, c, t, g, unknown or other
  modified_base (311)..(311): a, c, t, g, unknown or other
  modified_base (558)..(558): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctggtggagtcgtgggggagacttggtccagccgtggacgggtccctgagactctcctgtgcagcctntgctatccaccttcagtcgaaccacaacagtggacctcggggtcccnccgaggcctacccggaagggggaacgggggctggggaggtcgggggtaccggccgtaaattaaccgaaaggaaagctaaacagttacaaagtacaagaacgtaccgggcgcgtctaggtaggaaaagggtacgttccaaccgattccgtaacgaaaggtagtaattggaaacttacgaaaaacgtactacgaacgttgggtactcgtagaccaaagtcgaaactacggacctaacggaaaaaccggnggaaccacgggccttaggttaaactttagttgggtaaggttaaagaaacgaaaggttggttaaggagtgggttaggtggagtcgttaaggtaacg

SEQ ID NO: 360882 - DNA, 597 bp, Homo sapiens
  misc_feature: GZ8MTXP01BRSY1.21.4.A04.1.454.CMB.2.raw
  modified_base (216)..(216): a, c, t, g, unknown or other
  modified_base (288)..(288): a, c, t, g, unknown or other
  modified_base (303)..(303): a, c, t, g, unknown or other
  modified_base (510)..(510): a, c, t, g, unknown or other
  modified_base (559)..(559): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctctgctatcacttcagtcgaccacaacntggactcggggtccncgaggctccggaggggaggggctgggaggtcgggtcgacgtatacgaaggaaagctaaagagttaacaagtacaaggaatacgggcgcgtcgtaggtagaaaaggtacggttcaaccatctacgaagtagatagaacttacaaaagtactacacgttaggtactccgtagaacctaaatcgaaacgacgaccctaaggaaaacccgnggaaccgcggtaacgttgttaatttagttggtaggtaacgaagaaaggnggttggaattgggtaggtagggttactcgttggtaacg

SEQ ID NO: 360883 - DNA, 800 bp, Homo sapiens
  misc_feature: GZ8MTXP01DKUUE.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctctgtgcagcctctgctatccaccttcagtcgaacccaacaaacagtcggaccgtcggggtccccgccgacgggcctaccggaagggggaacgggggccgtggggagggttcgggggtccggtacccgttaagtttaaccgaaaaggggaaaacgacctaaaacgtagtttaaaccgaaaggttaaccaaggaaacgttaccgggccgtaccgttcgtagggtaagggaaaacgggtaacggtttacccaacccgtaagttaccgtaacgaaaaggtaaaggtaagttaggtaaactttaaaccgaaaaaacggtaaaccttaccgtaaaccgtttaggggttaaaccttaccgttaagaaacctaaaaacgttaccgggaaaacctaacggtaaaccccgtaaacggaaaaaaccccgggtaagggaacccgtaaccggggttaacccggttaagtttaaacgttttaagttgggttaaagggtaagttaaaacgaaaaggttagggtaagggtaagttgggttagggtagggttacgtcgttggtaacg

SEQ ID NO: 360884 - DNA, 707 bp, Homo sapiens
  misc_feature: GZ8MTXP01BXRIW.21.4.A04.1.454.CMB.2.raw
  modified_base (319)..(319): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtcagtgtgaggtgcagctgggtggagtcgtgggggatacgttggtccagccgtgggacggggtcccctgagtacctctcctggtcgcagcctctgctactcaccttcagtcgaaccacaactagtggacgtcggggtcccncgacggcctaccggaagggggtaagggggcgtagggggagggttcgggggtaccggaccgttaagttaacggaaaacggggtaaacgtacgtaaacgtaacggttaaccgaaaagttaacgaaggtaaacgtaccggggcgtcggttacgtagggtacgggtaaaagggtacgtttacaacccgtaatacgtacgaaagagtatagaacttaacaaacgtaacctcgtaaaccgttgtaacttacgtagaaccaaagtacgaaactacggacccgtaaaggaaaaccggaggaccgaacgggtcgttaagttagtttaagttggtaggttaacgaaacgttaaaaggttggtaagggtatgggtgggtaggttacgtcgttggtaacg

SEQ ID NO: 360885 - DNA, 505 bp, Homo sapiens
  misc_feature: GZ8MTXP01EIE1S.21.4.A04.1.454.CMB.2.raw
  modified_base (200)..(200): a, c, t, g, unknown or other
  modified_base (209)..(209): a, c, t, g, unknown or other
  modified_base (292)..(292): a, c, t, g, unknown or other
  modified_base (311)..(311): a, c, t, g, unknown or other
  modified_base (366)..(366): a, c, t, g, unknown or other
  modified_base (394)..(394): a, c, t, g, unknown or other
  modified_base (484)..(484): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatacgcctggtaccagcagaagcctggccaggcctcccaggttcctnatctatgctgggtcccagnggccactggcatcccagacaggttcagtgcaggtgggctgggacagacttcactntcatcattagcagactggagcctgaagnttcgctagtgtattactgtcagcagtagtggaagttcacctctagtcgttcggccgaagggaccaaaggtagtaaattagaaacgactgnggtctgcacgtaagttcttcg

SEQ ID NO: 360886 - DNA, 750 bp, Homo sapiens
  misc_feature: GZ8MTXP01AQ9VI.21.4.A04.1.454.CMB.2.raw
  modified_base (216)..(216): a, c, t, g, unknown or other
  modified_base (685)..(685): a, c, t, g, unknown or other
  modified_base (702)..(702): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctctgcatcaccttcagtcgaaccacaacagtcggactggggtcccgccgaggcctaccggagggggagggggctgggggaggttcgggggtccggtaccggtaagttaaccgaaagggaaacgtactaaaacgagtttaaccaaagttaaccaaggtaaacgtaccggggcgtacggttacgtagggtaaggaaaacgggtaacggtttaccaaaccccgtaattaccgtaacgaaaaggtaagtaacttaggtaaactttaaacgaaaaacgtaaaccttcctaaaccgtttaggggttaacttaccgttaggaacctaaaagttcgaaaccgtacggaacccgtaaaggaaaaaacccgggcggaaacgaaccggggtaacccgttaaggttaagtttaaagtttggggtaaacgggttaaanaaaacggttaaaagggngggttaaggtaagttggttaggggtaggttacgtcgttaagggtaacg

SEQ ID NO: 360887 - DNA, 558 bp, Homo sapiens
  misc_feature: GZ8MTXP01D765Q.21.4.A04.1.454.CMB.2.raw
  modified_base (267)..(267): a, c, t, g, unknown or other
  modified_base (283)..(283): a, c, t, g, unknown or other
  modified_base (305)..(305): a, c, t, g, unknown or other
  modified_base (421)..(421): a, c, t, g, unknown or other
  modified_base (524)..(524): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagtacgttggtccaggccgtgggacgggtccctgagactctcctgtgcagcctntgcatcaccttcagtnaccacaacatggactgggtccncgaggctcgaggggagggctggagtgggtcgactatacgaaaggaagctaacagttacaagtaacaaggaaactacgggcgcgtctagggtagaaaaggtaggttacacagtctanaaagagatgatacaaagactatactggtaatctgaactaaatcgaacagacctagaaaaccggagtacacggctgttaattagttgtacgtaagaacgaaagngtaagggtatgggtgggtgttagtcgttgtaacg

SEQ ID NO: 360888 - DNA, 588 bp, Homo sapiens
  misc_feature: GZ8MTXP01BWWOZ.21.4.A04.1.454.CMB.2.raw
  modified_base (199)..(199): a, c, t, g, unknown or other
  modified_base (287)..(287): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcacctgtctttgctccaggggaangccacctctcctgcagctccagccagaatatccagagctactacatagcctggtaccagcagaagcctggccaggctcccaggttccncatctatgctgggtcccacgagggcccacgtggcatcccagacaggttcagtggcaggtgggtctgggacagacttcactctacatcattacgcagactgggaagcctagaagtattcgacttaagttttattacgtggttacagtctaagttagtggtaagttcctaccgttcgttacggttccgtttcgggaaccgtaaaggggaacccgtaaagggttaagtaaaacgttaggaaaaaccggttacgttagggttaacgggacttaacggacctaaccttacttccgttcggtttccc

SEQ ID NO: 360889 - DNA, 653 bp, Homo sapiens
  misc_feature: GZ8MTXP01AFXU3.21.4.A04.1.454.CMB.2.raw
  modified_base (215)..(215): a, c, t, g, unknown or other
  modified_base (274)..(274): a, c, t, g, unknown or other
  modified_base (352)..(352): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacttggtccagcctggaggtccctgagactctcctgtgcagcctctgctatccaccttnagtcgaccacaacagtggactgggtccgccgaggcctcgaggggagggctgggagtgggtcgcgtatacgaaggaacnctaactagtacaagtacaagaactacgggcgacgtcgtaggagaaaagggtacgttaccaaccgtatctacgaaagagtagtagaattacgaaaacgtaactacctaagttcggttaaatcgtaggtaaaccaaaagttccgaaacgtaacggtaccccgtaaaacgggaaaaaccccgggaggtaaccgacccggggtaaccgttaagtttagtttaagttgggtaaagggttaacgaaacgaaaaagggttgtaaggggttacgtggggttagggttagggttagtcgttcggtaaccg

SEQ ID NO: 360890 - DNA, 651 bp, Homo sapiens
  misc_feature: GZ8MTXP01AD2MM.21.4.A04.1.454.CMB.2.raw
  modified_base (532)..(532): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagctgggttttccttgttgttattttacaaggtgtccagtgtgaggtgcagctggtggagtcgtggggggagacttggtccagccgtgggagggtccctgagactctcctgtgcagcctctgctattccaccttcagtcgacccaacaaacagtggactcgggtccccgccgaggcctccggagggggaggggcgtgggaggtggggtcggaccgtaagttacgaaaggaaacgctaacgagttacagtaaacagaagtacggcgcgtctaggtaggaaagggtacgttcaaccctatcctagaagagagtgaattacaaaagactcaacgttgtactacgtagaacctaaagtacgaaacgacgacccgtaaaggaaaaacccggnggaaccgaaccgggtccgttaagttaatttaggttaggttaggtaaagaaacgttaaaagggttgttacggggtaagttggggtggggttagggtacgttcgttgggttaacgtaaccg

SEQ ID NO: 360891 - DNA, 618 bp, Homo sapiens
  misc_feature: GZ8MTXP01CQXRD.21.4.A04.1.454.CMB.2.raw
  modified_base (215)..(215): a, c, t, g, unknown or other
  modified_base (259)..(259): a, c, t, g, unknown or other
  modified_base (279)..(279): a, c, t, g, unknown or other
  modified_base (295)..(295): a, c, t, g, unknown or other
  modified_base (343)..(343): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcctgttgttatttacaaggtgtccagtgtgaggtgcagctggtggagtcgtggggganacttggtccagcctggaggtccctgagactctctgtgcagcctngcatcacttcagtcgaccanaacatggactgggccncaggctcgagggaggctggagtgggtcgacgtatacgaagaagctaanagttacaagtacaagaaataccgggcgtcgtcgtagtaggaaaaggtacgggttacaaccgtagtcctaagaaaggaagtatacggtaattaacgaaaagaaacctactaaaccttgggtaacttcgtagaaaccaaagtacgaaacaaggtaccctaaaggaaaaacccgtagggaaccgtaaccgggtaaccgttaagttagtttaagttgggtaaaggttagaaacgttaaaggttaggtaaggagtgggtagggtggagtaagttcgtaag

SEQ ID NO: 360892 - DNA, 596 bp, Homo sapiens
  misc_feature: GZ8MTXP01C3D8H.21.4.A04.1.454.CMB.2.raw
  modified_base (216)..(216): a, c, t, g, unknown or other
  modified_base (305)..(305): a, c, t, g, unknown or other
  modified_base (550)..(550): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagcctgggagggtccctgagactctcctgtgcagcctctgcatcaccttcagtgaccacaacatcggactggggtcccnccgaggcctaccgagggggaaggggctgggagtgggtcgacgtataacgaaggaaacgactaacgagttacaaagtacaagtaaagtaccgggcgcgtactgtaggaaaggtacggttcaaccgtatctacaaagagatagaattacaaaagtactacaactggtaactcgtaagtacaaaagtcaaacgtagaacccgtagaaaaccggaggaccacggcgttagttattagttgtaagggtanaaacgaaaagttggtaaggtatggtagggtgttagtcgttgtaacg

SEQ ID NO: 360893 - DNA, 556 bp, Homo sapiens
  misc_feature: GZ8MTXP01AMJEI.21.4.A04.1.454.CMB.2.raw
  modified_base (217)..(217): a, c, t, g, unknown or other
  modified_base (289)..(289): a, c, t, g, unknown or other
  modified_base (303)..(303): a, c, t, g, unknown or other
  modified_base (351)..(351): a, c, t, g, unknown or other
  modified_base (383)..(383): a, c, t, g, unknown or other
  modified_base (420)..(420): a, c, t, g, unknown or other
  modified_base (437)..(437): a, c, t, g, unknown or other
  modified_base (478)..(478): a, c, t, g, unknown or other
  modified_base (485)..(485): a, c, t, g, unknown or other
  modified_base (522)..(522): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggganacttgggtccagcctggagggtccctgagactctcctgtgcagcctctgcatcaccttcagtgaccacaacntggactggggtccnccaggctccgaggggagggctgggagtgggtcgcgtatacgaaggaanctaacagttacaaagtacaagaaatacgggcncgtctgtagaaaagggaggttcaccgatctacaaganatgattacaaaagactnactggtatcgtgacaaatgaacagaccctaggaaaacccgnggaaccncggccgtgttattaagttggtaggtaagaacgaaagngtgggatgggtcgggtggttagtcgttggtaacg

SEQ ID NO: 360894 - DNA, 798 bp, Homo sapiens
  misc_feature: GZ8MTXP01C6AXO.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgtttattttacaaggtgtccagtgtgaggtgcagcgtgggtggagtcgtgggggagtacgttggtccagccgtggacgggtccctgagactctcctgtgcagcctctgctatccaccttcagtcgaaccaacaacagtcggaccgtcggggtcccgccgagggccgtccggaggggggaagggggtccgttagggggaggttcggggggttcccggtaccggttaagttaaaccggaaaagggtaaacggtactaaacgtaacgtttaaaccgaaaaggtttaaccaaggtaaacgttacccggggccgtcgtacgtaagggtaagggaaaacgggtaacggtttacccaaacccgttaactaccgttaacgaaaagggtaagtaagtttacgtaaacgtttaaaccaaaaaacggtaaccctttaaccgtaaaccgttttaggggttaactacccgttagtaaacccaaaaagttaccggaaactaccggtaaaccccgtaaagggaaaaaaccccggtcggaaccggtacccgggttaacggttaagttaagtttaacgttggggttaaaggtaagttaaaacgaaaggttaggttggaagttggtcggggtagttacgtcgttggtaacg

SEQ ID NO: 360895 - DNA, 665 bp, Homo sapiens
  misc_feature: GZ8MTXP01D5V46.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgctatccaccttcagtcgaccaacaacagtcggactcggggtcccgccgaggcctaccggagggggaacggggctggggaggttgggggtccggaccgttaagttaaccgaaagggaaacgtacgtaaacgagtttaaccaaagttaaaccaaggtaaacgtacccgggcgtaccggttacgtagggtaacgggaaaagggtacgttccaacctagtcctagaaagtagatagaattacaaaagactacaacgttgtaatctagaacaaagtcgaaactagacccgtaaaggaaaacccggtaggaaccacgggtccgttagttaaatttagttaggtaaggtaacgaaaagttaaaggaggttaagggagttgggtcgggtaggttagtcgttggtaaccg

SEQ ID NO: 360896 - DNA, 632 bp, Homo sapiens
  misc_feature: GZ8MTXP01ALJ7O.21.4.A04.1.454.CMB.2.raw
  modified_base (214)..(214): a, c, t, g, unknown or other
  modified_base (299)..(299): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtctggggganacttggtccagcctggaggtccctgagactctcctgtgcagcctctgctatcaccttcagtgaccacaacatggactggggtccnccaggctccgaggggaggggctgggaggtggggcgccgtaattacgaaaggaagctaaacagttacaaagtaacaaggaaataccgggcgcgtcgtaggtagaaagggtaggttacaaccatctacgaaagagtaatgtaattacgaaaagtaactctaactggtatactagactaaagtagaaacgtacgaccctaaacggaaaacccggaggaacccgacgggtaacccgttagggttaatttaggttagggttaacgggtaaaggttacgaaaaagggttacggtaaggggtaatcggggttaggggtacgggttaggtcgttggtaacg

SEQ ID NO: 360897 - DNA, 613 bp, Homo sapiens
  misc_feature: GZ8MTXP01BMAG3.21.4.A04.1.454.CMB.2.raw
  modified_base (293)..(293): a, c, t, g, unknown or other
  modified_base (307)..(307): a, c, t, g, unknown or other
  modified_base (358)..(358): a, c, t, g, unknown or other
  modified_base (422)..(422): a, c, t, g, unknown or other
  modified_base (429)..(429): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtggacgggtccctgagactctcctgtgcagcctctgctatcaccttcagtcgaccacaacntggactggggtccncgaggctaccgagggggagggctggaggtgggtcgccgtatacgaaggaanctaacagttacaagtacaagaactacgggcgcgtctggaggtaaagggtagttcacctatctanaaagganatgaacttacaaagtactcactggtaacttcgtagactaaagtcgaaacgacgtaacccgtaaaggaaaaccccggaggaaacccgtccgggaacgtttagttaaatttaggttaggtaaacgggtaagaaaacgaaaaggttggtaaggggtattggggtacggggtgttagcgttggtaacg

SEQ ID NO: 360898 - DNA, 564 bp, Homo sapiens
  misc_feature: GZ8MTXP01D1362.21.4.A04.1.454.CMB.2.raw
  modified_base (280)..(280): a, c, t, g, unknown or other
  modified_base (293)..(293): a, c, t, g, unknown or other
  modified_base (309)..(309): a, c, t, g, unknown or other
  modified_base (357)..(357): a, c, t, g, unknown or other
  modified_base (365)..(365): a, c, t, g, unknown or other
  modified_base (378)..(378): a, c, t, g, unknown or other
  modified_base (388)..(388): a, c, t, g, unknown or other
  modified_base (419)..(419): a, c, t, g, unknown or other
  modified_base (425)..(425): a, c, t, g, unknown or other
  modified_base (486)..(486): a, c, t, g, unknown or other
  modified_base (531)..(531): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagacttgggtccagccgtgggacgggtccctgagactctcctgtgcagcctctgcatcaccttnagtgaccacaacntcggactggggtcccncaggcctacgagggggaggctgggagtggcgacgtatacgaaaggaanctaaacgngttacaagtaacngaatacgggncgtctaggtagaaagagttcaccgtatctanaaaganatgtaatacaaaagtactcacttggtatctagacaaatgaacagaccctaaggaaaaccgnggtaacacggtccgtagttatagttgaaggtaacgaagttaaagnggtgagttcggtaggtggttatcgttggtaacg

SEQ ID NO: 360899 - DNA, 753 bp, Homo sapiens
  misc_feature: GZ8MTXP01BI7AC.21.4.A04.1.454.CMB.2.raw
  modified_base (314)..(314): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtgggggatacgttggtccagccgtgggacgggtccctgagactctcctgtgcagcctctgctatccaccttcagtcgaaccacaacagtcggacgtcggggtcccncgagggcctaccggagggggagggggctgggaggtgggtccggccgtaattaacgaaaggaaagtctaaacgtagttaacaaagttaaccaaggaaacgtaccgggcgtacgttacgtaggtaaggtaaaacgggtacggtttccaaccgtatcctaagaaaggtaagagttagaacttaacgaaaaagtaaccttacgaaccgttagggttaactccgtaagaaacctaaaagtacggaaacccgtaacggtaaccccgtaaaacggggaaaaaaccccgggagggtaaaccccgtaaaccgggggtcccgtttaaaggtttaaagtttaacggttttaggggtaaaggggttaaaacgaaaaccggttaaaaagggttagggttaagggtaaagttcggggttagggggttaggttaacggtcgtttcgggtaaacg

SEQ ID NO: 360900 - DNA, 717 bp, Homo sapiens
  misc_feature: GZ8MTXP01CPJDA.21.4.A04.1.454.CMB.2.raw
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgagtgcagctggtggagtcgtgggggatacgttggtccagcccgtgggagggtccctgacgactctcctgtgcagcctctgctatcaccttcagtgacccacaacagtggacgtcgggtcccnccgaggcctaccggagggggagggggctgggaggtggggtccggaccgttaagttaacgaaagggaaacgtactaaacgtaacgttaacaaacggttaacaaggtaaactacgggcggtacgtctagggtaaggaaaacgggtaggtttaccaacctaatcctaagaaagtagtaatggtaaactttaacgaaaagaaaccttcgtaacgttgggtaacttcgtagaaccaaaagtacgaaaaccgtagtaccccgaaaggaaaaaccccggacggtaaaccggccgggtaacccggtttaaggttaaagttttacggttgggtaaagggttaacgaaaacgggttaaaaggttaggtaaggggtattgggggttcgggttagggttacggtccgttgggtaaccg

SEQ ID NO: 360901 - DNA, 731 bp, Homo sapiens
  misc_feature: GZ8MTXP01ETDBL.21.4.A04.1.454.CMB.2.raw
  modified_base (271)..(271): a, c, t, g, unknown or other
  modified_base (292)..(292): a, c, t, g, unknown or other
  modified_base (296)..(296): a, c, t, g, unknown or other
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacaggtgtccagtgtgaggtgcagcgtggtggagtcgtgggggatacgttggtccaggccgtgggacggtccctgacgtactctcctggtcgcagcctntgctatcacttcagtcaccanaacntggactcgggtccncgacggctacgagggggagggctgggacggtcgggtacgcgtaagttaacgaaaggaagtactaaacgtagttaacccgaaagttaacgaaggtaaacgtcgggcccgtcgtacgttagggaaacggtaaaaggggttcttccaaaaccgttaagtaccgaagtaaacgtaagtaagtaacgtaacgtaaacgtaaacgtaaactaacgtaacgttaacggttaacgttacgtaacgtaacgtaaacgtaaacgtaaaccgtaaaccgtaaaccgtaaaccggtaaaaccggtaaaccggtaaccggtaacggtaaccggttaacggttaagttaacggttaacggtaacggtaaacggttaaacgttaaaggttaaggtaaggtaggtaaggtagggtaggttaggtaacgttaagtaag

SEQ ID NO: 360902 - DNA, 677 bp, Homo sapiens
  misc_feature: GZ8MTXP01BJGX5.21.4.A04.1.454.CMB.2.raw
  modified_base (216)..(216): a, c, t, g, unknown or other
  modified_base (262)..(262): a, c, t, g, unknown or other
  modified_base (275)..(275): a, c, t, g, unknown or other
  modified_base (279)..(279): a, c, t, g, unknown or other
  modified_base (288)..(288): a, c, t, g, unknown or other
  modified_base (301)..(301): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtggagggtccctgagctctcctgtgcagcctntgctatcaccttnagtnaccacaacntggactgggtccncgaggctcgaggggaggctggaggtggtcgacgtatacgaaaggaagctaaacgtagttacaagtaacgaagtaaacgtaccgggcgtcgtacgtagggtaaggaaacgggtaacgtttaccgaaccctataccgtacgaaagtaacgtattagaaacgtttacgaaaaagtaacctactaaaccgttagggttaacttaccgttaggaactaaaacgttacgaaacgaacgtacccgttaaaggaaaaccccggagggtaaaccggtaaccggggtaaccgttaggttaaatttacggtttaggtaagggttaaagaaacgaaaaagggttggttaagggacgttggggttaagggtcggttagtcgttggtaag

SEQ ID NO: 360903 - DNA, 684 bp, Homo sapiens
  misc_feature: GZ8MTXP01AZX8N.21.4.A04.1.454.CMB.2.raw
  modified_base (216)..(216): a, c, t, g, unknown or other
  modified_base (280)..(280): a, c, t, g, unknown or other
  modified_base (312)..(312): a, c, t, g, unknown or other
  modified_base (433)..(433): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctggtggagtcgtggggganacgttggtccaggccgtggacgggtccctgagactctcctgtcgcagcctctgctatcaccttnacgtcgaccacaactagtggacctggggtccncgaggcctcggagggggagggctgggaggtgggtcgcgtataacgaaggaagctaagagttacaaagtacaagaatacgggcgtcgtcgtaggtaagaaagggtacgttcaaccatcctanaagagatagagttacaaagtactactacttaggtatacgtagaacctaaaagtcgaaacctacgtaaccgtaaacggaaaaaacccggtcggtaaacccgaaccggggtaaccgttaagtttaacgttttaaacgggttagggttaaacggggtaaacgttaaaacgggttaaaaaggttacggggtttaagggtaaaggtttgggggttaggggttacggggttaagtcccggttaaggggttaaacccg

SEQ ID NO: 360904 - DNA, 742 bp, Homo sapiens
  misc_feature: GZ8MTXP01A0HV8.21.4.A04.1.454.CMB.2.raw
  modified_base (216)..(216): a, c, t, g, unknown or other
  modified_base (304)..(304): a, c, t, g, unknown or other
  modified_base (347)..(347): a, c, t, g, unknown or other
  modified_base (352)..(352): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagccgtggacgggtccctgagactctcctgtgcagcctctgcatcaccttcagtcgaccacaacatggactgggtccncgaggctcgagggagggctggagtggtcgcgtatacgaagaanctaanagttacaaagtacaagtaacgtacgggcgtcgtctaggtaggaaaagggtacgttacaacccgtattccgtacgaaaggtaagtattaggaaactttaacaaaaacggtaaccttacgtaaaccgttggggttaaacttaccgttacggaaaccaaaaagttcggaaaaccacggtaaccccgttaaagggaaaaaaaacccccgggtgggaaacccgtaaccccgggggtaaccgttttaaagggttaaacgttttaaacggtttggggttaaagggggtaaaacggttaaaaaccggttaaaaaaggggttacgggggtttaagggtaaaggtttaaggggttacggggggttaggttaaagggtcgtttaacggggttaaacccggg

SEQ ID NO: 360905 - DNA, 620 bp, Homo sapiens
  misc_feature: GZ8MTXP01AIETX.21.4.A04.1.454.CMB.2.raw
  modified_base (216)..(216): a, c, t, g, unknown or other
  modified_base (294)..(294): a, c, t, g, unknown or other
  modified_base (309)..(309): a, c, t, g, unknown or other
  modified_base (515)..(515): a, c, t, g, unknown or other
  modified_base (531)..(531): a, c, t, g, unknown or other
  modified_base (566)..(566): a, c, t, g, unknown or other
  modified_base (580)..(580): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtgggacgggtccctgagactctcctgtgcagcctctgctattcaccttcagtcgaaccacaacngtggactgggtcccncgaggcctaccggagggggaggggtctgggacggtcggggtaccggaccgtaattaacgaaaggaaacgtctaaacgagttaacagtaaaccagaacgtcgggcgtgtacgtaggtaaggaaagggtacgttccaacgtatacgacgaaagagtatagtaaattacgaaaagtactacacgttgtaatctagacaaagtcgaaacngacctaaggaaaccgngaccacggtctaataacgttagtggttaggtaaanaaacgttaaaaggnggttaggtaatgggtgggtaggtagcgttgaacggtaacc

SEQ ID NO: 360906 - DNA, 646 bp, Homo sapiens
  misc_feature: GZ8MTXP01BAKIY.21.4.A04.1.454.CMB.2.raw
  modified_base (202)..(202): a, c, t, g, unknown or other
  modified_base (295)..(295): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccagaatatccagagctactacatagcctggtaccagcagaacgcctggccaggcctcccgaggttccncatctatcgctcgggtccccacgacgggcccacgtggccactcccagactacggttcagtggcaggtgggtctgggacagtacttcactctcatcatagcagactggagccgtagaagtattcgactagttagttaacgtttacgtgttacagcgtaagttagtaggtaacgttctaaccgttcgttcggttccggtttaaccgggaacccggttaaacgggggtaaacccgttaaaagggggttaaaacgtaaaacgggttaacgggttaaaaaccggttaaccggttgggttaccggggtaaccgtttacgggacccttaacccgttaacggtttcccgttttaaccgg

SEQ ID NO: 360907 - DNA, 731 bp, Homo sapiens
  misc_feature: GZ8MTXP01ALXNJ.21.4.A04.1.454.CMB.2.raw
  modified_base (217)..(217): a, c, t, g, unknown or other
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttggtccagccgtgggacgggtccctgagactctcctgtgcagcctctgctatcaccttcagtcgacccacaacagtggactcggggtccnccgaggcctccggagggggacgggggcgtggggaggtcgggggtaccggtaccggtaagttaacgaaacggggaaagtacgtaaaccgaagtttaaccgaaaagttaaccgaaggtaaacgtaccggggcgtccggttacgtagggtaaagggtaaaacgggtacggtttaccaaacccggtattacccgtaacgaaaggtaagggaattagggtaaactttaaccgaaaaaacggtaacccttactaaaccgttagggttaacttacgtaggaacctaaagtacgaaaccacggtaaccgtaacggaaaaccccgggagtaaccggacccgggtcgttagtttaagttagttgggtaaagggtaacgaagaaaaggttgggtaagtaggttggtacgggtggttagtcgttgggtaacg

SEQ ID NO: 360908 - DNA, 817 bp, Homo sapiens
  misc_feature: GZ8MTXP01ALSLK.21.4.A04.1.454.CMB.2.raw
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggggagacgttggtccagcctgggacgggtccctgagactctcctgtgcagcctctgcattcaccttcagtcgaaccacaacagtggacgtgggtccccgcgaggcctaccggaagggggaacgggggcgtaggggacggtcgggggttaccggacccggttaaagttaaaccgaaaaggggtaaaaccgtaccttaaaacgtaaggtttaaacccgaaggttaaaacccgaaagggtaaacggtacccggggaccgggtacggttaccgttagggtaacggggtaaaaaacggggtaacgggtttaccaacccgtaagttaccgtaacgaaaaggtaagtaaagtacggtaaactttaaaccaaaacggtaaaccttacaacgtttaggttaacgttacgttaacggaaactaaaaacgttacggaaaaccgaacggtaacccgttaaacgggaaaaacccggtaacgggaaacccgtaaccggggtacccggttaaggtttaaagtttaggtttacgggttaagggtaaacggtaaaacgttaaaaaagggttggttagggtaagttgggttcgggttagggtaaggttcgttaaggttcgtaacg

SEQ ID NO: 360909 - DNA, 614 bp, Homo sapiens
  misc_feature: GZ8MTXP01AWUWA.21.4.A04.1.454.CMB.2.raw
  modified_base (278)..(278): a, c, t, g, unknown or other
  modified_base (309)..(309): a, c, t, g, unknown or other
  modified_base (373)..(373): a, c, t, g, unknown or other
  modified_base (480)..(480): a, c, t, g, unknown or other
  modified_base (559)..(559): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggatacgttggtccagccgtggacgggtccctgagactctcctgtgcagcctctgcatccaccttnagtcgaccacaacagtggactcggggtcccnccgaggcctaccggagggggaacggggctgggaggtggggtccgaccgtataaccgaaaggaanctaacgagttacaagtacaaggaactacgggcgcgtcgtagggtagaaagggtacgttacaaccagtctaacgaagagatagattaacaaagactcaactggtactntagaactaaagtcgaaaccacgtaccgtaaggaaaacccggaggaccacgggtcctaggttattagttggtaaggtaanaaacggaaaagttgggtggtaagtgggtagggtcggttaagtccgttggtaaccg

SEQ ID NO: 360910 - DNA, 690 bp, Homo sapiens
  misc_feature: GZ8MTXP01DH11G.21.4.A04.1.454.CMB.2.raw
  modified_base (219)..(219): a, c, t, g, unknown or other
  modified_base (270)..(270): a, c, t, g, unknown or other
  modified_base (318)..(318): a, c, t, g, unknown or other
  modified_base (549)..(549): a, c, t, g, unknown or other
  modified_base (580)..(580): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtgggtggagtcgtggggganacgttggtccagccgtgggacggtccctgagactctcctgtcgcagtcctntgctatccaccttcagtcgaccaacaacagtcggactcggggtccccnccgaggcctaccggaagggggaacggggtccgttagggggaggttcgggggtccggtaccgttaagttaaccgaaagggaaacgtactaacgtagttaacaaacgttaacaagtaaagtacgggcgtcgtcgtaggtaggaaaagggtacgttacaaccgtatacctagaaagaagtatagtaaactacaaaaagtctacgacttagggttaactcgtaagaccttaaaanacgaaacacgaaccgtaaacggaaaaccggnggaaccgtaccggtaacgttaagttaagtttaagttaggtaaaggtaaacgaaaaggttaaaggttaggtaaggtagttggggttagggtacggttacgtcgttggtaac

SEQ ID NO: 360911 - DNA, 670 bp, Homo sapiens
  misc_feature: GZ8MTXP01ADXRV.21.4.A04.1.454.CMB.2.raw
  modified_base (218)..(218): a, c, t, g, unknown or other
  modified_base (268)..(268): a, c, t, g, unknown or other
  modified_base (312)..(312): a, c, t, g, unknown or other
  modified_base (339)..(339): a, c, t, g, unknown or other
  modified_base (619)..(619): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttattttacaaggtgtccagtgtgaggtgcagcgtgggtggagtcgtgggggganacgttggtccagccgtgggacgggtccctgagactctcctgtgcagcctntgctatcaccttcagtcgaccacaacagtggactcggggtcccnccgaggcctaccggagggggacggggntggggaggtcgggggtcggaccgtaagttacgaaaggaatctaaacgagttaacgaaagttaacaaggtaaactaccggggcgtacggtacgtagggtaaggaaaacgggtacgttaccaacccgtatacccgtagaaaggagtagtagtaattaaaccgaaaagtaacctaccgtaagttacgggttaataccgtagaaccaaaagtacgaaacgacgtaacccgtaaagaaaacccggaggaaccgcgggtcgtagttattagttaggtacgggtaanaacgttaaaaggttggtaaggagttgggtcgggtaggagtcgttggtaacg

SEQ ID NO: 360912 - DNA, 887 bp, Homo sapiens
  misc_feature: GZ8MTXP01AGTBF.21.4.A04.1.454.CMB.2.raw
  modified_base (298)..(298): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggatacgttggtccagccgtgggacgggtccctgacgactctcctgtgcagcctctgctatccaccttcagtcgaacccacaacngtcggacgtcggggtcccgccgaggccgtaccggaaggggggtaacgggggcgttagggggacggggttcgggggtacccggtaccggtttaaagttaaccggaaaaggggtaaaacgtaccgttaaaacgtaacggtttaaaccgaaaacggttaaccgaagggtaaaccgttaacccggggccggttaccgggttaccgttaaggggttaaacgggaaaaaacggggttaaccggtttacccaaacccgtaagttaccgtaaccggaaaagggtacgtaagttacggtaaactttaaaccgaaaaaaaggttacccttactaaccgtttaggggtaacttccggttaacgaaaacctaaaagtccggaaaacgtaccggtaaacccggtaaacgggaaaaaaaccccgggtacggggtaaaccccgtaaccgggggttaacccgtttaaaggtttaaaccgtttttaagggttaggggttaaaccgggggttaaaaagaaaaccggttaaaaaagggttgggttaaggggtaaccgtttaagggggtagggggttaacgggttagtccgttaaggggttaaacccgg

SEQ ID NO: 360913 - DNA, 600 bp, Homo sapiens
  misc_feature: GZ8MTXP01BWKQA.21.4.A04.1.454.CMB.2.raw
  modified_base (203)..(203): a, c, t, g, unknown or other
  modified_base (297)..(297): a, c, t, g, unknown or other
  modified_base (398)..(398): a, c, t, g, unknown or other
tcagtcgtcgctcgcacgaccggtgctcgatttagagtagtgatcaggggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaancgccacctctcctgcagcctccagccagaatactccagagcctaactacatacgcctggaccagcagacgcctggccaggctcccgaggttccnatctatgtccgtcgggtccccagtacgggcccacgtcggacactcccgagaccgtaggttcaggtggcgtagggtcgggtcgtggggactaggtacttccncttctactactctattacgacaggtacgtgggacgtcctaggtaacgttcgtttcgacgtagtttcgttagtttacgtgtacgtagtacgtagtaagtggtaacttccgtaccttgtcgttcggtccggaacggacgggtacttaaagggtagtaaacgttaggttaacgttagtggtagcgtcgaccttactcgttcgttc

SEQ ID NO: 360914 - DNA, 814 bp, Homo sapiens
  misc_feature: GZ8MTXP01E0S5D.21.4.A04.1.454.CMB.2.raw
  modified_base (220)..(220): a, c, t, g, unknown or other
  modified_base (264)..(264): a, c, t, g, unknown or other
  modified_base (646)..(646): a, c, t, g, unknown or other
  modified_base (700)..(700): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggtttttccttgttgttattttacaaggtgtccagtgtgaggtgcagcgtggtggagtcgtggggganacgttggtccagccgtgggacggtcctgacgtctctctgtcgcncgtcctctgctactccaccttcgagtacgaacccacaacgtagtcggtaccgtccgggggtccccaccggacggtccgtaccgggaaggggggtacgggggtccggttaagggggtacgggggttcgggggtaccggtaccggttaaacgttaacggaaaaggggtaaactacgtaaacgtaacgttaaccgaaaagggttaaccgaagggtaaacgtacccggggacgtaccgggtttaacgttaaggggtaaacggtaaaacgggggttacccgtttaccaaacccgttagttacccgaaaggaaaagggtaacgttattacggtaaaaccttaaacgaaaaacgtacctttacgaactttaggggttaacttacggtanaaaactaaacgtcgaaaacctacggttaaacccgaaaagggaaaaccccggggnggaacccggtaccgggttaagtttaagttagttacggttaggggaaaagtaaacgaaagttaagggttcgggtaagtaggttggggtacgggtaggttactcggttaacgaacg

SEQ ID NO: 360915 - DNA, 863 bp, Homo sapiens
  misc_feature: GZ8MTXP01AHOVY.21.4.A04.1.454.CMB.2.raw
  modified_base (792)..(792): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctggtggagtcgtgggggatacgttggtccaggccgtgggacgggtccctgacgactctcctgtgcagcctctgctattccaccttgacgtcgaaccaacaaacgagtcgggaccgtcggggtccccgccgagggccctaccgggaaggggggtaacgggggtcgtagggggacggttcggggggtaccggtacccgttaaagttaaaccggaaagggaaaccgtaccttaaacgtaacggtttaaaccaaggttaaaaccaagggtaacgtaccggggtccggtaccgttcggtaagggtaacgggaaaacgggttaacggtttacccaaacccgtaacgttacccgtaaacgaaaaggtacggtaaagttaggtaaactttaaaccgaaaaacggtaccttaccgaaacgtttccggttaaattccgtaaacggaaacctaaaaggtaaccggaaaccgtaaccggtaaccccgtaaaaccggggaaaaaaccccggacgggtaacccggtaacgggttcccggtttaaagtttaaacgtttttaaggggttaacgggttaaggggttaaaaacgaaaaccgggttaaaaagggngggtttaggggtaaggttttggggtaacgggggttaaggtacgggttccgtttaagggaacgttaacccgg

SEQ ID NO: 360916 - DNA, 600 bp, Homo sapiens
  misc_feature: GZ8MTXP01AXL5C.21.4.A04.1.454.CMB.2.raw
  modified_base (217)..(217): a, c, t, g, unknown or other
  modified_base (261)..(261): a, c, t, g, unknown or other
  modified_base (266)..(266): a, c, t, g, unknown or other
  modified_base (276)..(276): a, c, t, g, unknown or other
  modified_base (280)..(280): a, c, t, g, unknown or other
  modified_base (285)..(285): a, c, t, g, unknown or other
  modified_base (288)..(288): a, c, t, g, unknown or other
  modified_base (301)..(301): a, c, t, g, unknown or other
  modified_base (527)..(527): a, c, t, g, unknown or other
  modified_base (571)..(571): a, c, t, g, unknown or other
  modified_base (588)..(588): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagccgtggacgggtccctgagactctcctgtgcngcctngcatcacttnagtnaccanaantggactcgggccncgaggcctacggaggggaggctggaggtgggcgacgtatacgaaggaacactaaacgagttacaagtaacgaagaaacgtccgggcgcgttactagggtaacggaaagggtacgttaccaactattacaacgaaaggaggattaggaattaccgaaaagacctactaaacgttggtactacctagaaacctaaaatcgaaacacgtaccctaaaggaaaacccggngtaacgacggtcgtagttattagttgtaggtaagaacgaaaggngtggatgggtacggtgngtcgttgtaacg

SEQ ID NO: 360917 - DNA, 733 bp, Homo sapiens
  misc_feature: GZ8MTXP01CMV72.21.4.A04.1.454.CMB.2.raw
  modified_base (217)..(217): a, c, t, g, unknown or other
  modified_base (279)..(279): a, c, t, g, unknown or other
  modified_base (309)..(309): a, c, t, g, unknown or other
  modified_base (362)..(362): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtggacgggtccctgagactctcctgtgcagcctctgctatccaccttnagtcgaccacacagtggactcggggtcccncgaggcctcgagggggacgggctggaggtgggtcggacgtatacgaacggaanactaagagtacaaagtacaagaaagtcgggcgcgtacgtaggtaggaaaagggtacggttccaaccgtatcctacgaaaggataagttaggtaatttaaaccgaaaaacgtaaaccttcgtaaaccgttaggggttaacttacgtacggaaacctaaaaagtacggaaaacccacgggtaaccctaaacggggaaaaaaccccgggtagggaaaccccgaaccgggggttaacccgtttaagggtttaaacgttttaacggttacgggtttaaaggggtaaaccgttaaaaacggaaaaagggttacgggttaaggggtaagtttaacggggtagggggttagggttaacggtccggttaagggtaaccgg

SEQ ID NO: 360918 - DNA, 761 bp, Homo sapiens
  misc_feature: GZ8MTXP01AJ5M2.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggatacgttggtccagccgtgggacgggtccctgacgactctcctgtgcagcctctgctactcaccttcagtcgacccacaacagtcggacgtcggggtcccgccgaacggcctaccggagggggacggggcgttggggagttcgggggtccggaccgttaagttaaccgaaagggaaactactaaaacgtacgttaacaaaggttaacgaaggtaaacgtaaccggggcgtcggttacgtagggtaaggtaaaacggggtacgtttacaaaccctagttacccgtaagaaaaggtacggaattaggtaaacttacgaaaaaacgtaccttaccgtaaacttggggtaaacttccgtaagaacttaaaacgtcggaaaacaccggtaaacccgtaaacgggaaaaaacccggtaggaaaccccgtaacgggggttaacccgtttaggttaaacggttttagttagggtaaacgggttaaaggaaaacttaaaaagggttgggttaagggagttcggggttagggtacggttaggtcgttggggttaaccg

SEQ ID NO: 360919 - DNA, 734 bp, Homo sapiens
  misc_feature: GZ8MTXP01BME83.21.4.A04.1.454.CMB.2.raw
  modified_base (217)..(217): a, c, t, g, unknown or other
  modified_base (265)..(265): a, c, t, g, unknown or other
  modified_base (281)..(281): a, c, t, g, unknown or other
  modified_base (303)..(303): a, c, t, g, unknown or other
  modified_base (350)..(350): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccagcctgggacgggtccctgagactctcctgtgcagcctntgcatcaccttcagtnaccacaacatggactgggtccncaggctacgaggggaggctgggagtgggtcgacgtatacgaaggaanctaaacgagttacaagtaacaagaaactacgggcgacgtcgtaggtaacggaaaagggtacgttccaacctaagtcctaacgaaaggtagtattaggaacttaacgaaaaacgtaacctacgtaacgttaggggttaacttaccgtaggaaacctaaaagttaccggaaaacctacggtaaaccccgtaaacggggaaaaaaaccccgggaggggtaaacccgtaaccgggggtaacccgtttaaggtttaaacgttttaacgggtttagggttaaacggggttaaagaaaaccgggttaaaaaaagggttggggtttaagggggtaaagttgggggttttaacgggggtagggttaacgggtaacccgtttggggttaaccgg

SEQ ID NO: 360920 - DNA, 629 bp, Homo sapiens
  misc_feature: GZ8MTXP01ED126.21.4.A04.1.454.CMB.2.raw
  modified_base (257)..(257): a, c, t, g, unknown or other
  modified_base (264)..(265): a, c, t, g, unknown or other
  modified_base (277)..(277): a, c, t, g, unknown or other
  modified_base (302)..(302): a, c, t, g, unknown or other
  modified_base (356)..(356): a, c, t, g, unknown or other
  modified_base (361)..(361): a, c, t, g, unknown or other
  modified_base (427)..(427): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagtcttgggttttccttgttgttattttacaaggtgtcagtgtgaggtgcagcgtggtggagtcgtgggggatacgttggtccagccgtggaggtccctgagactctcctgtncagcctnnctattccacttnagtcaccacaacagtggactggccncgaggcctacggagggagggctgggagtcgggtcgacgtaatacgaaaggaacnctaanagtacagtaacaagaacgtacggcgtcgtactaggtagaaaggtacgttacactatctagaagtanaatagtaacttaacgaaagtaactactaacgttagtaggtactagaaacctaaagtacgaaaccacggaaccgtaaacggaaaaccgagggtaccgacggtaccgttaagttaagtttagtaggttaacggtaaagaaagttaaaaggttggttagggtaagtcgggtgggttacggtagttcgttaaggttaacccgtaag

SEQ ID NO: 360921 - DNA, 634 bp, Homo sapiens
  misc_feature: GZ8MTXP01CO48Y.21.4.A04.1.454.CMB.2.raw
  modified_base (264)..(264): a, c, t, g, unknown or other
  modified_base (340)..(340): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggatacttggtccagcctggagggtccctgagactctcctgtgcagcctntgctatcaccttcagtcgaccaacaacagtggactggggtcccgccgaggctaccggagggggaaggggctagggnggttggggtcggtagtaattacgaaaggaatactaagtagttacaaagtacaaggaataccgggcgtcgtactaggtaacggaaaggtacgttcaacctatcctaacgaaagagtagtagaattaacgaaaacgtaacctctaactgggtaactcgtaagaactaaaatggaaactagaacctaacggaaaaccgaggaaaccacgggtccttaagttagtttaagttggtaaaggtaagaaaacgttaaaaggttggtaaggaagttggtagggtacggttagcgttgtaacg

SEQ ID NO: 360922 - DNA, 653 bp, Homo sapiens
  misc_feature: GZ8MTXP01BYEH5.21.4.A04.1.454.CMB.2.raw
  modified_base (216)..(216): a, c, t, g, unknown or other
  modified_base (563)..(563): a, c, t, g, unknown or other
  modified_base (603)..(603): a, c, t, g, unknown or other
  modified_base (616)..(616): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtcagtgtgaggtgcagctgggtggagtcgtggggganacgttggtccaggcccgtgggacgggtccctgagactctccgtgtgcagcctctgctatccaccttcagtcgaccacaacatggacgtcggggtcccgccaggcctccgagggggaggggcgtgggaggtggggtccggaccgttaatacgaaaggaaacgactaaactagttacaaagttaaccaaggaaacgtaccgggcgtacggttacgtaggtaaggaaaagggtacggttcaaaccctatctacaaaggtagagtagtaacttaacgaaaagtaacctacgaacttagggtaactcgtaagaacctaaaatcgaaacacgtaaccgtaacgaaaacccggngaacccgtacgggtcttaagttattagttggtagggtaanaaaacgttaaagnggtaaggaagtggtaggggtgttagtcgttaagaacg

SEQ ID NO: 360923 - DNA, 803 bp, Homo sapiens
  misc_feature: GZ8MTXP01B6QOM.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcgtgggggagacgttggtccagccgtgggacgggtccctgagtacctctcctgtgcagcctctgctattccaccttcagtcgaaccacaacagtcggacgtcggggtccccgcgacgggtccgtaccggaagggggaacgggggcgttagggggacgggttcgggggtaccggtaccgttaaagtttaaaccgaaaaggggtaaaacgtacgtaaaacgtaacggttaacgaaaaggttaaacgaagtaaacgttacccggggcgtaccggttcgtaagggtaaagggaaaacgggtaacggttcaaacccgtatccgtaacgaaaggaagtagtagtaaacttaacgaaaaacgtacttacgaactttaggggtaactcgttaagaaaccttaaaagcgaaaacccgacggtaaaccgtaaacggaaaaaacccgggtcggaaacccggtaccgggttaaccggtttaagtttaaacgtttaacggtttacgggtaaacggggttaaacgaaaacgggttaaaaaggttggggtttaaagggtagtttgggggttaccggggtaggtttaaggtccggttaagggttaaaccgg

SEQ ID NO: 360924 - DNA, 765 bp, Homo sapiens
  misc_feature: GZ8MTXP01AJMDC.21.4.A04.1.454.CMB.2.raw
  modified_base (601)..(601): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcaagaacgcctcggccacggcctcccacggttcctcatctatgccgtcgggtccccacgacgggcccacgtcggaccacgtcccgtaggacgtaccgggtttccaggtcgggaccgtaaggggttcggggtccggttaacggggaaccgtaacgttacccgtttacccaaccgtttctaacctaacttacccttaaagtttacggacctaaacgggttactacgggggtaaccgtacccgttaggtaaacgttacgtttccggaccgttaaggtttacggtaactttaacgtgggttaaccaggtaacgtaaggttaagtaccggggtaaacttttcccnccgtttaccgttcgggttcccggtttaaccgggaaccccggttaaaagggggtaacccgttaaaaggggtttaaaccgaaaaggttacccgggttaaaacgttaacgggttcgggtaccggtaaccgttacggaccccttaccggtaactttccgtttaaccgg

SEQ ID NO: 360925 - DNA, 574 bp, Homo sapiens
  misc_feature: GZ8MTXP01DLNJY.21.4.A04.1.454.CMB.2.raw
  modified_base (201)..(201): a, c, t, g, unknown or other
  modified_base (210)..(210): a, c, t, g, unknown or other
  modified_base (290)..(290): a, c, t, g, unknown or other
  modified_base (405)..(405): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctcccaggttccncatctatgctgggtcccacgagggccacgtggcatcccagacaggttcagtggcaggtgggtctgggacagacttcactctcatcattagcagactggagcctagaagtattcgntaagttgttaatttactggttacagtctaagttagtaggtaaagtttcctaaccttcgtcgttcggttcgggaccgttaaagggggaacccaaagggttaacgaaaagttacggaaaccgttaaacgttggtaacggtcgttacggaccttacccgtaattccgtttcg

SEQ ID NO: 360926 - DNA, 718 bp, Homo sapiens
  misc_feature: GZ8MTXP01BQH59.21.4.A04.1.454.CMB.2.raw
  modified_base (217)..(217): a, c, t, g, unknown or other
  modified_base (278)..(278): a, c, t, g, unknown or other
  modified_base (687)..(687): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtggacggtccctgagactctcctgtgcagcctctgctatccaccttnagtacgaccaacaacagttcggacgtcggggtccccgccgagggccgtaccggagggggtaacgggggccgtgggggaacgggttcggggggtacccggtacccgttaaagtttaaccggaaaaggggtaaacgtacgtaaaacccgtaggtttaacccaaaaggttaaccaaggtaaaacgttacccggggcgtccggttacgtagggttaagggaaaaacgggtacggttaccaaccctaatacctaacgaaaggtagtattaggtaaacttacgaaaaacgtacctacgtaaccttaggggtaacttcgtagaacctaaaagtcgaaacagtaacccgtaaacggaaaacccggagaacccgacgggtccgttaagttattagttggtaagtaagaaagttaaagnggtaacgagtggtacggtgagtgttgtaacg

SEQ ID NO: 360927 - DNA, 849 bp, Homo sapiens
  misc_feature: GZ8MTXP01DJD2X.21.4.A04.1.454.CMB.2.raw
  modified_base (192)..(192): a, c, t, g, unknown or other
  modified_base (843)..(843): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagttgggctgagcttgggttttccttgttgttattttacaaggtgttcagtgtgaggtncagcgtggtggagtcgtgggggatacgttggtccagccgtgggacgggttccctgacgactctcctgtcgcacgcctctgctaattcaccttcagtcgaacccaacaacagtcgggaccgtcggggtccccgcccgagggccctaccgggaaaggggggaacgggggtccgtagggggacgggtcgggggttaccgggacccgtttaaagttaaaccgaaaaggggtaaaacgaccttaaaacgtaggtttaaacccaaggttaaaacccaaaggtaacggttaccggggtacccggtacggtttaccgtaagggtaacgggggtaaaaaacggggttaaacgggtttacccaaacccgtaaacgtttacccgtaacgtaaaaggtaagtaaagttaggtaaactttaaaccgaaaaaacggttaaaaccttccgtaaactttacggttaaactttaccgttaacggtaaacctaaaaagttaacgaaaacccgaacggttaaccccggtaaaacggaaaaaacccgggtacgggaaaccgtaacccgggggtaccgttaaggttaacgttttaaggttagggttaaacgggtaaagtaaaacggaaaaggttggttagggtaagttagggtgggtacggtagttcgttgngtaacg

SEQ ID NO: 360928 - DNA, 618 bp, Homo sapiens
  misc_feature: GZ8MTXP01BKX0T.21.4.A04.1.454.CMB.2.raw
  modified_base (218)..(218): a, c, t, g, unknown or other
  modified_base (285)..(285): a, c, t, g, unknown or other
  modified_base (290)..(290): a, c, t, g, unknown or other
  modified_base (294)..(294): a, c, t, g, unknown or other
  modified_base (309)..(309): a, c, t, g, unknown or other
  modified_base (361)..(361): a, c, t, g, unknown or other
tcagtcgtcgctcgcacgaccggtgctcgatttagagtagtgatcaggggagctctgagagcggagccccagccccagaattcccaggttgttttcatttggtgatcagcactgaacacagaggactcaccatggagtttgggctgagcttgggttttccttgttgttatttacaaggtgtccagtgtgaggtgcagcgtggtggagtcgtggggganacgttggtccagccgtgggacggtccctgagactctcctgtgcagcctctgctatccaccttcagtnaccanaacngtggactgggtcccncaggctccggaggggacgggctggaggtgggtcgacgtaatacgaaaggaanctaaagagttacaagtacaagaactcgggcgcgtgaggtagaaagggtagttcaacctatctaacaagtagatagtaactacaaaagtactacaacgttgggtaacttcgtagaaactaaagtcgaaaccgacgtaacccgtaaacgaaaacccgggagacccgaacggggtctttagttaaatttagttagggtaaaggtaacgaaagaaaagggttgtaaggtagttgggttacgggtggttactgttggtaacg

SEQ ID NO: 360929 - DNA, 684 bp, Homo sapiens
  misc_feature: GZ8MTXP01BKI7U.21.4.A04.1.454.CMB.2.raw
  modified_base (259)..(259): a, c, t, g, unknown or other
  modified_base (462)..(462): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcttgttgttatttacaaggtgtccagtgtgaggtgcagctggtggagtcgtgggggagacttggtccagccgtgggacgggtccctgagactctcctgtgcngcctctgctatcaccttcagtcgaccaacaacagtggacgtcggggtcccgccgacggcctaccggagggggaagggggcgtggggaggttgggggtccggaccgtaagttaaccgaaaggaaagactaaacgaagttacaaagtaacaaggaaatacgggcgtcgtctggtaaggaaagggtagttccaacctaatcctaanaaaggagtaattaggaacttaaacgaaaaagtaccttacaacgtttagggttaacttccgtagaaactaaaagtcggaaaccacggtaacccgtaaaggaaaaaccccggaggaacccgtaccgggtaaccgttagttaagtttagttagggtaaggtaagaaaacgaaaagggttggtaagggtaattggggttagggtacggttagtcgtttggaaccgg

SEQ ID NO: 360930 - DNA, 664 bp, Homo sapiens
  misc_feature: GZ8MTXP01BE0CG.21.4.A04.1.454.CMB.2.raw
  modified_base (217)..(217): a, c, t, g, unknown or other
  modified_base (587)..(587): a, c, t, g, unknown or other
  modified_base (630)..(630): a, c, t, g, unknown or other
  modified_base (638)..(638): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagccgtgggacgggtccctgagacctctcctggtcgcagtccctctgctatccacccttcagtcgaacccacaaacagtgggacctcggggtcccaccgaggcctaccggagggggacggggcctaggggtaggtcgggggtccgaccggttaattaaccgaaagggtaaacgctaaacgagttaccaaagtacaagaacgtaccgggcgtcggtactaggtaggaaaacgggtacggttccaacctaagtccgttacgaaaagtacgtaagttcggaaacttaacgaaaacgtacctacgtaacgttcgggtaaactccgtagaacaaacgtgaaacacggaccctaaaggaaacccgnggaccgacggtctagttacttgttgtacgtaagaacgaaaggngtaagggnttgggaggtcgttagcgttggtaacg

SEQ ID NO: 360931 - DNA, 566 bp, Homo sapiens
  misc_feature: GZ8MTXP01EPLH1.21.4.A04.1.454.CMB.2.raw
  modified_base (263)..(263): a, c, t, g, unknown or other
  modified_base (302)..(302): a, c, t, g, unknown or other
  modified_base (347)..(347): a, c, t, g, unknown or other
  modified_base (353)..(353): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctntgcatcacttcagtgaccacaacatggactcggggtccncaggctccgaggggagggctggagtgggtcgcgtatacaaggaanctaacngttacaagtacaagaatacgggcgcgtcgtaggaggaaaggacggttcaacatctcgaaagagattagaattacaaaagtactacacttaggtatctagacaaatcgaaacacgacctaaggaaaacccgaggaccacgggtcgttagttaattagttagaggttaagaacgaaaaggttggtaaggtatgggtggtgggactcgttgtaacg

SEQ ID NO: 360932 - DNA, 716 bp, Homo sapiens
  misc_feature: GZ8MTXP01BO5UN.21.4.A04.1.454.CMB.2.raw
  modified_base (215)..(215): a, c, t, g, unknown or other
  modified_base (311)..(311): a, c, t, g, unknown or other
  modified_base (367)..(367): a, c, t, g, unknown or other
  modified_base (373)..(373): a, c, t, g, unknown or other
  modified_base (398)..(398): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacgttggtccagcctgggacgggtccctgagactctcctgtgcagcctctgctatccaccttcgagtcgaccacaacagtggacctcggggtcccncgaggcctaccggagggggagggctgggaggtgggtcgaccgtatacgaaaggaanactaanagttacaagtacaagaataccgggntcgtactgggtaaggaaacgggtacgttaccaaccgtataccctaagaaaggaagtaattaggaaacttaccgaaaaacgtaacttacgtaaaccgttgggttaaacttccgttaggaacctaaaagtacgaaaccgaaccggtaacccgtaaacggaaaaaccccgggtaggaaaccccggtaaccggggtaacccgtttaaggttacgttttaaagttaggggtaaacgggttaaagaaaaccgttaaaaaggggttcgggttaagggtagttggggttaacggggtagggttaacggtccgttaaggtaaccggg

SEQ ID NO: 360933 - DNA, 650 bp, Homo sapiens
  misc_feature: GZ8MTXP01ER4KZ.21.4.A04.1.454.CMB.2.raw
  modified_base (301)..(301): a, c, t, g, unknown or other
  modified_base (438)..(438): a, c, t, g, unknown or other
  modified_base (593)..(593): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagccgtggagggtccctgagactctcctgtgcagcctctgcatcaccttcagtgaccacaacatggactggggtccncgacggctaccgaggggagggctgggaggtgggtcgccgtaatacgaaaggaagactaaacgtagttacgaagttaacaaggaaagtaccgggcgtcgtactagggagaaaagggtacggttcaacctatccgtaanaaaggtaagaagttagaactttaacgaaaacgtaactactaacgttaggggttataccgttagaacctaaaagtacgaaacgaacgacccgtaaagaaaacccggtagaacccgagggtaaccgttagttagtttaagttggtaaggggtaaaanaaacggttaaaggttggtaaggtaggttgggtagggtaggttacgtcgttggtaacg

SEQ ID NO: 360934 - DNA, 708 bp, Homo sapiens
  misc_feature: GZ8MTXP01CQMKV.21.4.A04.1.454.CMB.2.raw
  modified_base (218)..(218): a, c, t, g, unknown or other
  modified_base (315)..(315): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctgggtggagtcgtgggggganacgttggtccaggcccgtggacgggtccctgagactctcctgtgcagcctctgctatcaccttcagtacgaccaacaacagtggactcggggtcccnccgaggcctaccggagggggaggggctgggaggtgggtccgaccgttagtaaccgaaaggaacgctaaacgagttaacaagttaaccaaggtaaacgtaccggggcgtaccggttactagggtaaggtaaaagggtacggtttaccaaaccgattacgtaactaaaggagtaattagaacttaacgaaaagtaactcaacttggttaactcgtagaacaaaagtcgaaaacgacgtaacccgtaaacggaaaaacccggacgggaaccgtaaccggggtaacccgtttaaaggttagttttaaacggttgggttaaaacggggaacgttaaaacggaaaaggttagggttaagggaagtttgggttaggggtacggttagtccgttggtaacg

SEQ ID NO: 360935 - DNA, 816 bp, Homo sapiens
  misc_feature: GZ8MTXP01ANK8Q.21.4.A04.1.454.CMB.2.raw
  modified_base (295)..(295): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtgggtggagttcgtgggggatacgttggtcccaggcccgtgggacgggtcccctgacgtactctccgtgtcgccagtccctctgctatccaccttnagtacgaacccaacaacagtcggacgtcggggtaccccgccgacggtccgtaccggaaggggggaacgggggtccgttagggggtacgggttcgggggtaccgggtaccgttaagttaaaccgaaaaggggaaaccgtacgtaaacgtaacggtttaacgaaaacggttaaccgaaggtaaacgttacccgggcggtaccgttacggttagggtaaagggtaaaacggggttacgtttacccaaaccctaagtttcccgaaagaaagggtaagtacttaaggaaactttaaaccgaaaaagttaccttaccctaaagtttggggttaactaccgttaacggaactaaaaaagttccggaaaactaccggtaaccccgtaaagggaaaaaaccccggtgggaacccctacggggtccgtttaagtttaagttagttaggggtagggaaaaacttaaacggaaaaggttggggtttaaggtagttggggttaccggggtggttaacgccgtttaagggaaccg

SEQ ID NO: 360936 - DNA, 631 bp, Homo sapiens
  misc_feature: GZ8MTXP01EDM8W.21.4.A04.1.454.CMB.2.raw
  modified_base (200)..(200): a, c, t, g, unknown or other
  modified_base (209)..(209): a, c, t, g, unknown or other
  modified_base (232)..(232): a, c, t, g, unknown or other
  modified_base (264)..(264): a, c, t, g, unknown or other
  modified_base (285)..(285): a, c, t, g, unknown or other
  modified_base (376)..(376): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatanccagagctatacatagcctggtaccagcaganctggcaggctccaggttcctnatctatcgctcgggtcccacgacgggcccatggcactcccagaccacggttcaggtggcaggttgggctggggactaggtacttcgattcncatcattagcgagactgggacgtccttagaagtactttcgactagttggttaatttacttaggttccaagtcgtaaggttagttagggtaaacgtttcctaacccgttcgttcgggttccggtttaaccgggaaccgttaaagggggaaaccttaaaggggttaaacggtaaaaagttaacgggttaaaaccggttaaacgttgggttacgggaaccgttcgggacccttaaccgtaacgtttccgtttaaccgg

SEQ ID NO: 360937 - DNA, 564 bp, Homo sapiens
  misc_feature: GZ8MTXP01AN1G4.21.4.A04.1.454.CMB.2.raw
  modified_base (302)..(302): a, c, t, g, unknown or other
  modified_base (435)..(435): a, c, t, g, unknown or other
  modified_base (444)..(444): a, c, t, g, unknown or other
  modified_base (475)..(475): a, c, t, g, unknown or other
  modified_base (482)..(482): a, c, t, g, unknown or other
  modified_base (529)..(529): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgctatcaccttcagtcgaccacaacatggactgggtccncaggctccgaggggagggctggagtgggtcggccgtattacgaaggaaagctaaacagttacaagtacaagaatacgggcgcgtctggagaaaggagttcaccatctacgaagagatgaattacaaaagactnactggtatntgacaaatgaacagacctaaggaaaacccgnggaaccncgggccgttagttaagttagttagggtaggtaacgaaacgaaaaggnggtaaggatgggtagggtgggttatcgttgtaacg

SEQ ID NO: 360938 - DNA, 578 bp, Homo sapiens
  misc_feature: GZ8MTXP01BYK7W.21.4.A04.1.454.CMB.2.raw
  modified_base (216)..(216): a, c, t, g, unknown or other
  modified_base (262)..(262): a, c, t, g, unknown or other
  modified_base (305)..(305): a, c, t, g, unknown or other
  modified_base (348)..(348): a, c, t, g, unknown or other
  modified_base (353)..(353): a, c, t, g, unknown or other
  modified_base (377)..(377): a, c, t, g, unknown or other
  modified_base (408)..(408): a, c, t, g, unknown or other
  modified_base (431)..(431): a, c, t, g, unknown or other
  modified_base (441)..(441): a, c, t, g, unknown or other
  modified_base (456)..(456): a, c, t, g, unknown or other
  modified_base (474)..(474): a, c, t, g, unknown or other
  modified_base (534)..(534): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctntgctatcaccttcagtcgaccacaacagtggactggggtcccncaggctcgaggggagggctggagtgggcgcgtatacaaggaanctaanagttacaagtacaagaatcgggcncgtctggtagaaagggtagttcaccatctanaagagatgattacgaaaagactnactggtactntagacaaatgaaacngaccgtaagaaaacccgngggaaccaccgggtccgttagttaactttagttggtaagggtaagaaaacgttaaaaggnggttaagggaattgggttcggggtaggttagtcgttgggtaacg

SEQ ID NO: 360939 - DNA, 707 bp, Homo sapiens
  misc_feature: GZ8MTXP01BV3BV.21.4.A04.1.454.CMB.2.raw
  modified_base (300)..(300): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagtcttgggttttccttgttgttattttacaaggtgtccagtgtgaggtgcagcgtgggtggagtcgtgggggatacgttggtccagccgtgggacgggtccctgagactctcctgtcgcagcctctgctatccaccttcagtcgaaccaacaacngtggaccgtcggggtccccgccgacgggcctaccgggaaggggggaacgggggtctagggggacgggttcgggggtccgggtaccgttaaagttaaaccggaaaagggaaacgtacgttaaacgtaagtttaaaccgaaagtaaccaagggaaacgtaccgggcgtccggttacgtagggtaagggaaaacgggtacggttacaacccagtacctagaaagtagtatagaacttaacgaaaacgtacctacgtacttaggtaactcgtagaactaaatcgacctaagtaccctaaacggaaaaccggtacggaaccgacgggtccgttaagtttacgttaagttggtaaaggttaagaaaacgaaaggttggtaaggtagttcggtgggtagacgtgttaagtaacg

SEQ ID NO: 360940 - DNA, 646 bp, Homo sapiens
  misc_feature: GZ8MTXP01EM47W.21.4.A04.1.454.CMB.2.raw
  modified_base (264)..(264): a, c, t, g, unknown or other
  modified_base (280)..(280): a, c, t, g, unknown or other
  modified_base (303)..(303): a, c, t, g, unknown or other
  modified_base (357)..(357): a, c, t, g, unknown or other
  modified_base (504)..(504): a, c, t, g, unknown or other
  modified_base (527)..(527): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacttggtccagcctggacgggtccctgagactctcctgtgcagcctntgctatcacttcagtnaccacaacatggactggggtccncgaggcctcgaggggaagggctgggagtgggtcggccgtaatacgaaaggaacnctaaacgagttacaagtaacaagaactacgggctcgtctaggtaggaaaacgggtacgttcaaccgtatacctagaaaggtaggaattggaacttacaaaagtaacctacaacgttagggtacttactgaacctaaaagtcgaaacncgtacccgtaaggaaaaacccgngggaaccctcggggtaaccttaggttaaattagttagggtaggtaaaacggaagttaaaaagggagggttaagggaacgttgggttaggggtagggttaaccgtcgttaaggtaaccgg

SEQ ID NO: 360941 - DNA, 663 bp, Homo sapiens
  misc_feature: GZ8MTXP01BYUYZ.21.4.A04.1.454.CMB.2.raw
  modified_base (216)..(216): a, c, t, g, unknown or other
  modified_base (264)..(264): a, c, t, g, unknown or other
  modified_base (276)..(276): a, c, t, g, unknown or other
  modified_base (280)..(280): a, c, t, g, unknown or other
  modified_base (285)..(285): a, c, t, g, unknown or other
  modified_base (289)..(289): a, c, t, g, unknown or other
  modified_base (301)..(301): a, c, t, g, unknown or other
  modified_base (320)..(320): a, c, t, g, unknown or other
  modified_base (348)..(348): a, c, t, g, unknown or other
  modified_base (354)..(354): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacgagaggactcaccatggagtttgggctgagctgggttttcttgttgttattttacaaggtgtccagtgtgaggtgcagctggtggagtcgtggggganacttggtccagcctgggacgggtccctgagactctcctgtgcagcctntgctatcacttnagtnaccanaacntggactgggccnccagctcgaggggagggcngggagtgggcgcgtatacgaaaggaacnctaaangttacaagtaacaagaatacggggctacgtctagggtagaaaagggtgttcaaaccagtcctagaaaggagaatggaattaaccaaaaggaaccttcaaacgttggttaactagttacggaacttaaaaaggcgaaaccgacgtaacccggtaacgaaaaaaccccgggggagaccggtaccgggtaaccggttaaagttacgtttaacgttacggggtaaacgggtaaaacgaaaacgggttaaaaggttggggttaacgggtaacgtttggggtaagggttacgggttacgtccgttaaggtaacgg

SEQ ID NO: 360942 - DNA, 543 bp, Homo sapiens
  misc_feature: GZ8MTXP01D7RQR.21.4.A04.1.454.CMB.2.raw
  modified_base (301)..(301): a, c, t, g, unknown or other
  modified_base (345)..(345): a, c, t, g, unknown or other
  modified_base (430)..(430): a, c, t, g, unknown or other
  modified_base (474)..(474): a, c, t, g, unknown or other
  modified_base (512)..(512): a, c, t, g, unknown or other
  modified_base (527)..(527): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcatcaccttcagtcgaccacaacatggactgggtccncaggctcgagggagggctggagtgggtcgcgtatacgaaggaanctaacagttacaagtacaagaaatacgggcgcgtcgtagtagaaaggtaggttcaaccatctacaagagatgattacaaagactnactggtatctgacaaatgaacagacccgtagaaaaccgaggacncgggtcgtgttattagttgtaggtaacgaagaaaaggngtgggatgggtgggnggttatcgttgtaacg

SEQ ID NO: 360943 - DNA, 862 bp, Homo sapiens
  misc_feature: GZ8MTXP01D0AC7.21.4.A04.1.454.CMB.2.raw
  modified_base (264)..(264): a, c, t, g, unknown or other
  modified_base (309)..(309): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtgggggagacgttggtccagccgtggaggtccctgagactctcctgtgcagccctntgcattcaccttcagtcgaccacaacagtggaccgtggggtcccnccgaggccgtaccgagggggaacggggcgtagggtacggtcgggggtccggaccgttaagttaaccgaaaagggtaaagacctaaacgtaacgtttaacgaaaacgttaacaaggaaacgttaccggggaccgtacggtaccgtaggggtaacgggtaaaaacgggtaacgggtttaccaaacccctaaggttaccttaacgaaaaggtaacggtaattacggtaaacgtttaaacaaaaaacggtaacccttaactaaaccgtttaggggtttaaacgttcccttaaagggaaaccctaaaaaagttaccgggaaaacctaaaccggggttaaaccccttaaaacggggtaaaaaaaccccggggtaacgggaaaccccgtaaccgggggtaaacccgtttttaaggggttaaacttttttaaagggtttcggggtttaaaacgggggttaaaaggaaaaaccgttaaaaaggggttaacggtttaagggggtaaaccggttttcggggttagggggtaccgggtttaagtccgggtttaaggggttaaccg

SEQ ID NO: 360944 - DNA, 712 bp, Homo sapiens
  misc_feature: GZ8MTXP01BPLQ8.21.4.A04.1.454.CMB.2.raw
  modified_base (205)..(205): a, c, t, g, unknown or other
  modified_base (240)..(240): a, c, t, g, unknown or other
  modified_base (246)..(246): a, c, t, g, unknown or other
  modified_base (296)..(296): a, c, t, g, unknown or other
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggccaccttgttctttgtctccgaagggggaaancgcccaccctctcctgcagcctccagccagaatanccaganctactacatagcctggacagcagacgcctggccaggcctccgaggttccnatctatgcgtggacccagcggcccagtcggcacgtcccaagtaccgtacggttcaggtcggacgtaggggttcggggtccgtggggtaacctaacgggtacctttaccaacgtttcctactaactaccttaagttaccgacgtaacgtacgttacggggaaccgtccgttaaggtaacggttaacgtttcgggacttaagggtttacgttaatttacggttaggttaccaagggtacctaagggttagtaacggggttaaacgtttccctaaccgtttcggttcggttacccgggttaaccgggaaccggttaaaacgggggaaaccgttaaaggggttaaacgtaaaacgttaacgggaaaacccgttagggtaacgggtggcttacgaccgttaacctaacgtttcgttaaccg

SEQ ID NO: 360945 - DNA, 646 bp, Homo sapiens
  misc_feature: GZ8MTXP01AL02Z.21.4.A04.1.454.CMB.2.raw
  modified_base (216)..(216): a, c, t, g, unknown or other
  modified_base (264)..(264): a, c, t, g, unknown or other
  modified_base (631)..(631): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggacgggtccctgagtactctcctgtgcagcctntgcatccaccttcagtcgaccacaacagtggacgtggggtccccgccgaggccgtaccgagggggaaggggccgtgggtaggtcgggggtccggaccgttaaagttaacgaaacgggaaacgtctaaacgtagttaaccaaaggttaaccgaagtaaacgtacccgggagtccgttacgtaggtacggaaaagggtacgttcaaccgtatcgtaacaaggatagtgaacttacaaaagtacctacacttaggtactcgtagaacctaaaagcggaaacacgaccgtaagaaaaaccggcgaacgaccggtcgtaagttattagttggtaaggtaacgaaagaaaggttggtaaggattgggtacggnggttatgttgtaacg

SEQ ID NO: 360946 - DNA, 648 bp, Homo sapiens
  misc_feature: GZ8MTXP01BP2DF.21.4.A04.1.454.CMB.2.raw
  modified_base (270)..(270): a, c, t, g, unknown or other
  modified_base (315)..(315): a, c, t, g, unknown or other
  modified_base (561)..(561): a, c, t, g, unknown or other
  modified_base (603)..(603): a, c, t, g, unknown or other
  modified_base (615)..(615): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttatttacaaggtgtccagtgtgaggtgcagcgtggtggagtcgtgggggatacgttggtccagccgtgggacgggtccctgacgtactctcctgtgcagcctntgctatccaccttcagtcgaccacaacagtcggactcgggtcccncgaggctcggtaggggagggctgggaggtcgggtcgacgtagttaacgaaaggaagactaagagttacgaaagtaacaaggtaaacgtaccgggcgacgttacgtaggtaggaaaacgggtacgttaccaaccctatccgtaacgaaaggtaagtaacgttagtaaacttaacgaaaacgtaactactacttagggtacttacgtagaactaaagtcgaaactacgacccgtaaaggaaaacccgnggtaaccgcgggtcgttagttagtttagttgtaaagggtaanaaagttaaaggnggtaagtagtggtacgggtgacgtgttgtaacg

SEQ ID NO: 360947 - DNA, 586 bp, Homo sapiens
  misc_feature: GZ8MTXP01AXPOC.21.4.A04.1.454.CMB.2.raw
  modified_base (216)..(216): a, c, t, g, unknown or other
  modified_base (266)..(266): a, c, t, g, unknown or other
  modified_base (292)..(292): a, c, t, g, unknown or other
  modified_base (306)..(306): a, c, t, g, unknown or other
  modified_base (350)..(350): a, c, t, g, unknown or other
  modified_base (514)..(514): a, c, t, g, unknown or other
  modified_base (556)..(556): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagccctgggacgggtccctgagactctcctgtgcagcctntgctatcaccttcagtgaccacaacntggactggggtccncaggctccgagggagggctggagtggtcgcgtatacgaagaacncaacgagttacaagtaacaagtaaactacgggcgcgtactaggtagaaaagggtaacggttcaaacctaatcctaacgaaagaaggactaggaatttaaccgaaaagtactacaactgggtaatcctagactaaatgaaacacgacctagaaaaccgaggaccncgggccttagttaacttagttgtaggtaacgaagttaaaagnggtaagatggtgggcgttagtcgttgtaag

SEQ ID NO: 360948 - DNA, 629 bp, Homo sapiens
  misc_feature: GZ8MTXP01AWJO9.21.4.A04.1.454.CMB.2.raw
  modified_base (216)..(216): a, c, t, g, unknown or other
  modified_base (291)..(291): a, c, t, g, unknown or other
  modified_base (303)..(303): a, c, t, g, unknown or other
  modified_base (350)..(350): a, c, t, g, unknown or other
  modified_base (355)..(355): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtggggganacgttggtccagccgtggacgggtccctgagactctcctgtgcagcctctgctatcacttcagtcgaccacaacntggactgggccncgaggcctcgaggggaggcgtggagtgggtcgacgtatacgaagaanctaanagtacaaagtacaagtaaatgtcgggcgtacgtactaggtaggaaaagggtagttaccaacctagtccgtaagaaagagtatagaaattaccgaaaaagtacctacgtaattgtaacgtacctaggaaacctaaagtcgaaaactacgaccgtaaaccggaaaaccggcggtaccgaacggtaccgttataaacggtttagtggtaagggttaaagaacgttaaaaaggtgggtacgtaagttggggtaggttaccgggtaagttccgttaagg

SEQ ID NO: 360949 - DNA, 577 bp, Homo sapiens
  misc_feature: GZ8MTXP01CLI4C.21.4.A04.1.454.CMB.2.raw
  modified_base (212)..(212): a, c, t, g, unknown or other
  modified_base (260)..(260): a, c, t, g, unknown or other
  modified_base (281)..(281): a, c, t, g, unknown or other
  modified_base (301)..(301): a, c, t, g, unknown or other
  modified_base (358)..(358): a, c, t, g, unknown or other
  modified_base (364)..(364): a, c, t, g, unknown or other
  modified_base (394)..(394): a, c, t, g, unknown or other
  modified_base (431)..(431): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgttagttatttacaaggtgtcagtgtgaggtgcagctggtggagtcgtggggganacttgggtccagccgtggacgggtccctgagactctctgtgcagcctntgcatcaccttcagtgaccanaacatcggactgggtacccnccaggctccggaagggggagggctgggagtggggtacgaccgtaatacgaaaagganactaanagttacaagtacaagaaatacggcgacgtntaggtagaaaggtagttccaaacctatccagaaaganactgaattacaaaacgtaatcaaattggtaatcgtagaaacgaaagtaagaacgacgaacgaaacgtaaacgaacgaacgacgtaacgtagttagttagttagtagtaagaagaaagagtaagtagtgtggtgttagtgttgtaag

SEQ ID NO: 360950 - DNA, 721 bp, Homo sapiens
  misc_feature: GZ8MTXP01DE4ZN.21.4.A04.1.454.CMB.2.raw
  modified_base (218)..(218): a, c, t, g, unknown or other
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtggggganacgttggtccagccgtggagggtccctgagacctctcctgtgcagcctctgctatccaccttcagtcgaccacaacatggactcgggtcccnccgaggcctaccggagggggaaggggtcgtagggaggttcgggggtccggtaccgtaagttaacgaaacgggaaacgtactaaacgtagttaacgaaagttaacgaagaaacgtaccgggacggtacgtcgtaggtagggaaaacgggtacgtttacaacctagtcaacgaaaggaagtaagttagaacttaacgaaaagtaacctactaaccgttaggtaacttaccgtaggaaacctaaaagtccgaaacgacgtaacccgtaaaggaaaaacccggtggaacccgtaacggggtccgtttaagttaaagttttagttcggttaaacgggtaagaaaacggttaaaagggttgggttaagggtaagttgggggttagggttaccgggttacgtcggttaagtaaccggg

SEQ ID NO: 360951 - DNA, 805 bp, Homo sapiens
  misc_feature: GZ8MTXP01A2FLZ.21.4.A04.1.454.CMB.2.raw
  modified_base (646)..(646): a, c, t, g, unknown or other
  modified_base (721)..(721): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttccttgttgttatttacaaggtgtccagtgtgaggtgcagcgtggtggagtcgtggggggatacgttgggtccagtccgtgggacgggtccctgagtacctctcctgtcgcagtcctctgctactccaccttcagtacgaaccacaactagtggaccgtcggggtccccgccgacgggcctaccggaaggggggaacgggggtcgtagggggtacgggttcgggggtaccggtaccgttaagttaacggaaacggaaacgtactaaaacgtagttaacaaagttaaccgaaggtaaacgtaccgggacgtcgttacgtagggtaaggaaaacgggtacgttaccaaaccgtatacgtaacgaaagtaaggtattaggtaaacttacgaaaaaacgtacttaccgaaacgttacggggtaacttaccgtaagaaacctaaaaagtaccggaaaaccgacggtaaaccccgtaaacggggaaaaaaccccggngggtaaaaccccggacggggttaacccggtttaaagtttaaaccggtttaagttggggttaaaaccggggtaaanaaaaaccgggttaaaagggttagggtttaacgggaaaggttcgggttagggggtagggttaaacgtccgtttaagggtaaccgg

SEQ ID NO: 360952 - DNA, 612 bp, Homo sapiens
  misc_feature: GZ8MTXP01B2ZA7.21.4.A04.1.454.CMB.2.raw
  modified_base (247)..(247): a, c, t, g, unknown or other
  modified_base (301)..(301): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggccaccctgtctttgtcctccgaggggaaagacgccaccctctcctgcagcctccagccagaatactccaganctacacatacgcctaggaccagcagacgcctggaccaggcctcccgaggttccncatctatgctcggtccccagacgggcccacgtcggccacgtccccagaccgtacggttcaggtcggctaggtcggggtcctggggactacggtacttcacttcactatctattacggctaggtactagggacgtcctaggaagtacgtttacgacgtagttgttacgtttacgtggtacaggtactagttagtacggtaacgttcctaccgttcgttcggtaccggtcgggaaccgttaagggtaaccgttaaaggtaaagaacgttaggaaaccgttagtggtaggctcgggacttaccgtcttcgttcg

SEQ ID NO: 360953 - DNA, 639 bp, Homo sapiens
  misc_feature: GZ8MTXP01CKZB1.21.4.A04.1.454.CMB.2.raw
  modified_base (269)..(269): a, c, t, g, unknown or other
  modified_base (280)..(280): a, c, t, g, unknown or other
  modified_base (331)..(331): a, c, t, g, unknown or other
  modified_base (358)..(358): a, c, t, g, unknown or other
  modified_base (587)..(587): a, c, t, g, unknown or other
  modified_base (598)..(598): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttccttgttgttattttacaaggtgtccagtgtgaggtgcagctggtggagtcgtgggggagtacgttggtccagccgtgggacgggttccctgacgactctcctgtgcagcctngcatcaccttnagtgaccacaacatggactggggccgccaggcctcgaggggagggctgggnggtggtcggcgtagtacgaacggaaanctaacagttacgaagttaacaagaagtacgggcgtcgtcgtcggtagaaaggagttcacctatctacaagagtaatgtaattacgaaaagtacctcgaaccttaggggtaacttcgtagaactaaagtacgaaacgtacgaacccgtaaacggaaaaccggtacggaaccgacgggtaacccgttagttagttttaacgttggttaaagggaacgaaacggttaaaggngggttaagggngttaagggttggggtacgggttaacgtcgttgggtaaccgg

SEQ ID NO: 360954 - DNA, 679 bp, Homo sapiens
  misc_feature: GZ8MTXP01AZ9K5.21.4.A04.1.454.CMB.2.raw
  modified_base (217)..(217): a, c, t, g, unknown or other
  modified_base (306)..(306): a, c, t, g, unknown or other
  modified_base (311)..(311): a, c, t, g, unknown or other
  modified_base (330)..(330): a, c, t, g, unknown or other
  modified_base (403)..(403): a, c, t, g, unknown or other
  modified_base (482)..(482): a, c, t, g, unknown or other
  modified_base (533)..(533): a, c, t, g, unknown or other
  modified_base (545)..(545): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccaggccgtgggacgggttcccctggagaccttctccgtggtgcacgtcctctagcctattccaccttgagtcgaacccanaaacngtcggacctggggtccccncgtacggcctaccgggaagggggaggggtctgggggtagtcggggtccggaccgttaataaccgaaaggaacnctaaacaggtttacaaagttacaagtaaacgtcgggcgcgttcagggtaaagaaaacgggtacggttaccaaccgtaanaccgtagaaagagtatagtaattaacgaaactaaactctaacgtgtaactntcgaaactaaanacgaacgacgtaaccgtaaacggaaaccgacggaaccgtcggtaacgttagttaacgttagttaggtaaacggtaaagaaacggttaaagttgggtaagtaggtcgggtagggtacggttcgtcgttggtaacg

SEQ ID NO: 360955 - DNA, 579 bp, Homo sapiens
  misc_feature: GZ8MTXP01BBGL5.21.4.A04.1.454.CMB.2.raw
  modified_base (257)..(257): a, c, t, g, unknown or other
  modified_base (262)..(262): a, c, t, g, unknown or other
  modified_base (274)..(274): a, c, t, g, unknown or other
  modified_base (304)..(304): a, c, t, g, unknown or other
  modified_base (361)..(361): a, c, t, g, unknown or other
  modified_base (390)..(390): a, c, t, g, unknown or other
  modified_base (452)..(452): a, c, t, g, unknown or other
  modified_base (477)..(477): a, c, t, g, unknown or other
  modified_base (494)..(494): a, c, t, g, unknown or other
  modified_base (543)..(543): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtcagtgtgaggtgcagctgggtggagtcgtgggggagacttggtccagcctgggacgggtccctgagactctctgtgcngcctntgcatcaccttnagtagaccacaacagtggactcggggtccncaggcctacggagggggagggctagggagtgggggtacgccgtaattacgaaggaanactaacagtacaagtacaagatacgggcncgtctaggagaaagggtagttacacctatctagaagaagtatagaattaccaaaagacttanactggtatctagactaaatgaaacnggaacctagaaaaccgngtaaccgacggcgttgttaattgttggtaaggtaagaaagttaaaaggngtaagggtgtcgggtaggttgggaatcgttggtaag

SEQ ID NO: 360956 - DNA, 725 bp, Homo sapiens
  misc_feature: GZ8MTXP01BBUFT.21.4.A04.1.454.CMB.2.raw
  modified_base (203)..(203): a, c, t, g, unknown or other
  modified_base (304)..(304): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctcctgcagctccagccagaatatccagagctaactacatacgcctaggtaccagacagaacgccgtggccaggcctccccgaggtttccncatctagtcgaccgtcgggtccccaggacgggccctagtcggaccaactccccgaggtacctagggttccagggttcggacgtaaggggttcggggtccgtaagggggaaccctaacggtacctttaccgaaccgttcgtaacgtaacttacctaaagtttaacggaccgaaggtaaccgttaggggaaccgtaccgttaggaaacggttaacgttttccgacgttaaaggtttacgttaacgtttaacgttcggttaaccgaacggtattaaggttaacgttaggggtaaacttttcccaacccgtttgttaccggttccgggttaaccgggaacgaaacggggtaccttaaagggttaaacgaaaagttacgggaaacgttaacgtggtaggtcctacgacgacctaagttcgttaacg

SEQ ID NO: 360957 - DNA, 822 bp, Homo sapiens
  misc_feature: GZ8MTXP01B5VQO.21.4.A04.1.454.CMB.2.raw
  modified_base (264)..(264): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggacgggtccctgagactctcctgtgcagcctntgctatcaccttcagtcgaaccaacaacagtcggaccgtggggtccccgcacgggcctaccggagggggaagggggctggggagggtcgggggtaccggaccgttaagttaaccgaaagggaaagtctaaacgtaggttaaccaaaggttaacaaggaaacgtaccggggcgtcgttacgtagggtaacgggtaaaacgggtacgggtttcccaacccgtagtaaccgttaaccgaaaagggtacgggtaaattagggtaaactttaaaccgaaaaaaggtaaacccttaccgtaaaccggtttaggggttaacgtttacccgtaagggtaaaccctaaaaaagttcccgggaaaacctaaaccgggaaccccgttaaagggaaaaaaacccccggggtaggggaaaaccccgtaaccgggggtaaccccgttttaggttaaaccgttttaaggttaggggttaaacggggtaaaggttaaaaccgttaaaaaggggttacgggttaaggggtaagttggggttagggggttagggttaggtccgttaagggtaaccg

SEQ ID NO: 360958 - DNA, 649 bp, Homo sapiens
  misc_feature: GZ8MTXP01BR0CB.21.4.A04.1.454.CMB.2.raw
  modified_base (451)..(451): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtggacgggtccctgagactctcctgtgcagcctctgctactcaccttcagtcgaccacaacagtggacgtcggggtcccgccgaggcctaccggagggggacggggcgtagggaggtggggtccggaccgtagttacgaaggaaacgtactaagagttacaaagtacaagaagtcgggcgcgtcgtaggaggtaaaggtagttccaaccgtatccgtanaaaggtaacgtattgaaacttacgaaaagtaacctcgaacttggtaactcgtagaacaaaagtcgaaactacggacccgtaaacggaaaaccggagacccgaacggggtcctttaagttaattttacgttgggtaacggtaagaaacgaaaggttggtaaggtacgttgggttacgggtggttagtcgttggtaaccg

SEQ ID NO: 360959 - DNA, 589 bp, Homo sapiens
  misc_feature: GZ8MTXP01A7V0C.21.4.A04.1.454.CMB.2.raw
  modified_base (217)..(217): a, c, t, g, unknown or other
  modified_base (255)..(255): a, c, t, g, unknown or other
  modified_base (261)..(261): a, c, t, g, unknown or other
  modified_base (271)..(271): a, c, t, g, unknown or other
  modified_base (275)..(275): a, c, t, g, unknown or other
  modified_base (281)..(281): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (341)..(341): a, c, t, g, unknown or other
  modified_base (346)..(346): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgttcagtgtgaggtgcagcgtggtggagtcgtggggganacttggtccagccgtggacggtccctgagctctcctgncagctngcattcactnagtnacacantggactgggtccncaggcncggagggaggcngggagtgggtcgccgtatacgaaggaacnctaanagtacagtaacagaataccgggcgtcgtacgtagtacgggaaaggtaacgtcaacgatactacgaagtagatagtaattacaaaagtacctacacgttagtaatcttaggaaaccaaagtacgaacgacgaaccgtaaacggaaacgtacgggacacgggtcgtaagtattagtgttaggtaacgaagaaaggttggttaggtaaggtggttaacgggtagggtacgttgtcggttcgtaacg

SEQ ID NO: 360960 - DNA, 669 bp, Homo sapiens
  misc_feature: GZ8MTXP01B1KQM.21.4.A04.1.454.CMB.2.raw
  modified_base (269)..(269): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggttttccttgttgttatttacaaggtgtccagtgtgaggtgcagcgtggtggagtcgtgggggatacgttgggtccaggccgtgggacgggtccctgagactctcctgtgcagcctntgctatcaccttcagtcgaccacaacagtcggacgtcggggtcccacgacggctaccggaggggaggggctgggaggtcgggtacgcgtatacgaaggaagctaacgagttacaagtacaaggaatacgggcgtcgtcgtaggtagaaaacgggtacgttacaacctatactacgaaaggacgtaatagtaattaacgaaaacgtacctacgtaacttaggggtaacttacgtacgaacctaaaagccgaaacgaacgtaacccgtaaagggaaaaccccggagggaacccgtacgggtaacccgttagttaaacgtttaggttagggtaaggtaacggaaacgttaaagggttaggtaagggtagttgggtggggttacggttagtccgttggtaaccg

SEQ ID NO: 360961 - DNA, 577 bp, Homo sapiens
  misc_feature: GZ8MTXP01BB6IM.21.4.A04.1.454.CMB.2.raw
  modified_base (216)..(216): a, c, t, g, unknown or other
  modified_base (263)..(263): a, c, t, g, unknown or other
  modified_base (548)..(548): a, c, t, g, unknown or other
  modified_base (555)..(555): a, c, t, g, unknown or other
  modified_base (563)..(563): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgagactctctgtgcagcctntgcatccaccttcagtcgaccacaacagtcggacgtcggggtcccgccgaggcctccggagggggaacggggcgtgggaggtgggtcggacgtatacgaaacggaaagctaacagttacaagtaacaaggaaacgtacggcgcgtcgtaggtaggaaagggtacgttacaacctattcacgaaagagtatcgaattacaaaagtactacacgttggtaatcgtagactaaagtcgaacagacctaagaaaccggagaccgacggcttagttattagttgtagaanacgaagngtgatggngtgactgttgtaag

SEQ ID NO: 360962 - DNA, 638 bp, Homo sapiens
  misc_feature: GZ8MTXP01A7FGN.21.4.A04.1.454.CMB.2.raw
  modified_base (216)..(216): a, c, t, g, unknown or other
  modified_base (266)..(266): a, c, t, g, unknown or other
  modified_base (313)..(313): a, c, t, g, unknown or other
  modified_base (600)..(600): a, c, t, g, unknown or other
  modified_base (619)..(619): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtggggganacgttggtccagccgtggacgggtccctgagtactctcctgtgcagcctntgctatctaccttcagtacgaccacaacagtggacgtcggggtcccnccgaggcctaccggagggggaagggcgtgggaggtcggggtccggaccgttaattaacggaaaggaaagtactaaacgtagttaacaaagtaacaaggaactacgggctcgtcgtaggtagaaagggtacgtacaccatctacaagagtatagaattaacaaaagtactacgaacttggttaactacgtacgaacttaaagacgaaacacgaacccgtaaggaaaacccggaggtaccgacggtaaccgttaagttagtttattaggttaggaacaaagttaaaagngggttaagagtggttgggnggttagtcgttggtaaccg

SEQ ID NO: 360963 - DNA, 772 bp, Homo sapiens
  misc_feature: GZ8MTXP01A04R1.21.4.A04.1.454.CMB.2.raw
  modified_base (266)..(266): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagacttggtccagccgtggacgggtccctgagactctcctgtgcagcctntgctatcaccttcagtacaccaacaacatggacgtcggggtcccgcgaggccgtaccggagggggaaggggtcgtgggaggttcgggggtccggaccgttaataacgaaaggaaagtacgtaaactagtaacaaagttaacgaagtaaatccggggcgtcggttactagggtaaaggaaaacgggtacgttacccaacctagtaccgtaagtaaagagaagtttaacgaattaaaccgaaaacgtaaaccttcctaaacgttggggttaaacttaccggtaaacgaaaaccgtaaaagtaccggaaaaccgtaaccggtaaaccccggtaaaaccggggtaaaaccgggaccggtaaacccggtaaccgggttaaccgtttaaggttttaaagtttaaggttacggggttaaaacgggtaaaaacggaaaacggttaaaaggttaggggtaagggtaaggtttgggggttacgggggttaggttacgttcgggttaacggtaacgg

SEQ ID NO: 360964 - DNA, 759 bp, Homo sapiens
  misc_feature: GZ8MTXP01BMU7H.21.4.A04.1.454.CMB.2.raw
  modified_base (316)..(316): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaggtgtcagtgtgaggtgcagcgtggtggagtcgtgggggagacgttggccagccgtgggacgggtccctgacgactctcctgtcgcacgcctctgctactccaccttcagtcgaaccacaacagtggaccgtcggggtccccnccgaacgggtccgtaccggagggggaagggggtcctagggggtagggtcgggggttaccggaccgttaaacgttaaaccggaaaggggtaaaacgtcctaaaacgtacggttaaccaaaggttaaaccaaggtaaacgtaccgggcggtaccgtacgtaggggtaaggtaaaacgggtacgggttacccaaacgtactacgtaacgaaagtaaggtaattacgaacgtttaacaaaaacgtaacctacgtaaaccgttaggggttaactccgtaagtaaaccaaaagttaccgaaaccgaacgtaaccccgtaaagggaaaaccccggtacgggtaaacccgaccggggtaaccctttaggttaaacgttttagttaggtagggtaaagttaaacgaaaagggttggtaagggtagtggtacgggtgttacgtcgttgtaacg

SEQ ID NO: 360965 - DNA, 571 bp, Homo sapiens
  misc_feature: GZ8MTXP01AC9VH.21.4.A04.1.454.CMB.2.raw
  modified_base (305)..(305): a, c, t, g, unknown or other
  modified_base (354)..(354): a, c, t, g, unknown or other
  modified_base (383)..(383): a, c, t, g, unknown or other
  modified_base (387)..(387): a, c, t, g, unknown or other
  modified_base (405)..(405): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagcctggacgggtccctgagactctcctgtgcagcctctgcatcaccttcagtcaccacaacatggactggggtcccncgaggctccgagggggagggctggagtgggtcgccgtatacgaaggaantaacgagttacaagtacaagatacgggcncgtntgtagaaaggagtcacanctacaagagatgaattacaaacgtactatactcggtatctagaacaaagtcgaaacagtacccgtaaggaaaaccggagaccggacggtccgtagttactttagttggtaggtaagaacggaaaaggttaggtggagttgggtagggtggttacgtgttggtaacg

SEQ ID NO: 360966 - DNA, 699 bp, Homo sapiens
  misc_feature: GZ8MTXP01B4J92.21.4.A04.1.454.CMB.2.raw
  modified_base (200)..(200): a, c, t, g, unknown or other
  modified_base (294)..(294): a, c, t, g, unknown or other
  modified_base (315)..(315): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccacctgtcctgcagctccagccagaatatccagacgtcctactacatacgcctggtaccagcagagcctggccaggcctcccgaggttcctnatctatgcgtcgggtcccagnggccagtggcatcccagactggtcagtgcaggtgggctgggacagtccttcgacttcgtacactcctagttacggacctaggtaccttaggggaaccgtccgttaaggtaaacgttacgttttaccggcgttaaggtttcggttaaacttttacgtacgggttaccaagggttaccgtaaagggtttacgttaccgggggtaaaacttttcccaaacccgtttcggtttcgggttacccgggtttaaccgggaaacccgttaaacgggggtaaccccgttaaaaggggttaaccggtaaaaacgtttacgggaaaaccgggttaaaccgttggggtaaccgggtcttacgggaccttaaccgtaacgtttcccggtttaaccgg

SEQ ID NO: 360967 - DNA, 615 bp, Homo sapiens
  misc_feature: GZ8MTXP01DJDEA.21.4.A04.1.454.CMB.2.raw
  modified_base (216)..(216): a, c, t, g, unknown or other
  modified_base (269)..(269): a, c, t, g, unknown or other
  modified_base (283)..(283): a, c, t, g, unknown or other
  modified_base (314)..(314): a, c, t, g, unknown or other
  modified_base (384)..(384): a, c, t, g, unknown or other
  modified_base (393)..(393): a, c, t, g, unknown or other
  modified_base (594)..(594): a, c, t, g, unknown or other
tcagtcgtcgctcgcacgaccggtgctcgatttagagtagtgatcaggggagctctgagagcggaaccccagccccagaattcccaggtgttttcatttggtgatcagcactgaacacagaggactcaccatggagtttggctgagcttgggttttccttgttgttatttacaaggtgtccagtgtgaggtgcagcgtggtggagtcgtggggganacgttggtccagccgtgggacgggtccctgagactcctccgtgtgcacgcctntgctattcaccttnagtcgaaccacaacagtgacgtcgggtcccnccgaggccgtaccggagggggaggggcgtagggaggtgggtaccggaccgttaaattacgaaaggaaacncctaaacgngttaacaagtaaacaagtaacgtacgggtcgacgttctagggtaggaaaaggggacgttaccgacatacacgaaagaagatagtaacttaacgaaagaaactcaattcgtaatactagaaacaatacgaacgacgacgtaaacgaaaccggagaccgacggtcgtaagtattagttggaagtaacgaagaaagttgttagngtagtggtgtagctgcgtaag

SEQ ID NO: 360968 - DNA, 695 bp, Homo sapiens
  misc_feature: GZ8MTXP01BT89H.21.4.A04.1.454.CMB.2.raw
  modified_base (215)..(215): a, c, t, g, unknown or other
  modified_base (301)..(301): a, c, t, g, unknown or other
  modified_base (389)..(389): a, c, t, g, unknown or other
  modified_base (459)..(459): a, c, t, g, unknown or other
  modified_base (467)..(467): a, c, t, g, unknown or other
  modified_base (646)..(646): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcgttggttttccttgttgttatttacaaggtgtccagtgtgaggtgcagctggtggagtcgtggggganacgttggtccagccgtgggacggtccctgacgactctccgtgtcgcacgcctctcgctattccaccttcagtcgaacccacaaacngtcggacgtcgggtccccgccgaggcctaccggaagggggtacggggctagggaggttcggggtcggaccgtaataacgaaggaaacnctaaacgagttacagtaaacagaagtaccggcgcgttacgtaggtaaggaaacgggtacgttccaacctnttccgaanaaggagtactagtaaacttacgaaaagtcctctaacgttcgtaagttcaaggaacctaaagttacgaaacctgggtaaacccgtaacggaaaaaccccggtagggacccgtaaccggggttaccgttaagtttaacgtttaggttaacggttaaggtaaaccgaaaagttaaaaggggnggttagggtaagttcggggtaaggtgtacgttacgtaacgttaagaacg

SEQ ID NO: 360969 - DNA, 858 bp, Homo sapiens
  misc_feature: GZ8MTXP01C1ABR.21.4.A04.1.454.CMB.2.raw
  modified_base (260)..(260): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtgggtggagtcgtgggggatacgttggtccagccgtgggacggtcctgagactctcctgtncagcctctgctatccaccttcagtcgaaccaacaacgtatcgggaccgtcggggtccccgacgacgggccgtaccgggaagggggaagggggtccgtagggggacgggttcggggggtaccggtaacccggttaagttaaaccggaaaaggggtaaaacgtacgttaaaacgtaagtttaaacccgaaaaggttaaaccaagggtaaacgttaccggggacgtaccggtacgtagggttaaacggaaaacgggtacgtttacaaccgtaatacctacgaaaagaggtaattagtaaacttaaacgaaaacgtaaaccttactaacgtttagggtttaaactcgtttaaacggaaacctaaaagttacccggaaaccgtaaccgggtaaacccgttaaaaccggaaaaaaccccggggtaggggaaaccccggtaacgggggttaaccccgttttaagggggtttaaactttttaacggggttaaagggttttaaacggggaaagttaaaaaaaccggggttaaaagggttaaggggttaaccgggtaaagtttgggggttaggggttaggggttaacccggttgggttcggtaaacgg

SEQ ID NO: 360970 - DNA, 707 bp, Homo sapiens
  misc_feature: GZ8MTXP01ALOOV.21.4.A04.1.454.CMB.2.raw
  modified_base (217)..(217): a, c, t, g, unknown or other
  modified_base (260)..(260): a, c, t, g, unknown or other
  modified_base (265)..(265): a, c, t, g, unknown or other
  modified_base (308)..(308): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggganacgttggtccagcctggacgggtccctgagactctcctgtgcngcctngcatcacttcagtcgaccacaacagtcggacgtcggggtcccnccgagggcctaccggagggggaacgggggtcgtgggggtaggttcgggggtaccggacccgttaaagttaaccggaaagggtaaaacgcgtaaacgtaagttaacgaaagttaaccaaggtaaacgtaccggggtcgtaccggttacgtagggtaaaggtaaaacgggtacgtttccaaaccctagtacccgtagaaaaggagtacgtaggtaaacttaaccgaaaaacgttactaccgtaaacgttgggttaaacttcgtaacggaaacctaaaagtcgaaaccgtaagaacccgtaaggaaaaccccgggaggaccgccgggtcgtagttaacgttagttaggtaggtaacgaaagaaaaggttggtaagtcgtgggtggtaggttgcgttgaaccg

SEQ ID NO: 360971 - DNA, 530 bp, Homo sapiens
  misc_feature: GZ8MTXP01D32KE.21.4.A04.1.454.CMB.2.raw
  modified_base (214)..(214): a, c, t, g, unknown or other
  modified_base (273)..(273): a, c, t, g, unknown or other
  modified_base (282)..(282): a, c, t, g, unknown or other
  modified_base (299)..(299): a, c, t, g, unknown or other
  modified_base (342)..(342): a, c, t, g, unknown or other
  modified_base (347)..(347): a, c, t, g, unknown or other
  modified_base (421)..(421): a, c, t, g, unknown or other
  modified_base (457)..(457): a, c, t, g, unknown or other
  modified_base (470)..(470): a, c, t, g, unknown or other
  modified_base (496)..(496): a, c, t, g, unknown or other
  modified_base (523)..(523): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttnagtgaccanaacatggactgggtccncaggctccgaggagggctgggagtgggcgcgtatacaaggaanctaangttacagtaacagaagtacggcgcgtctgtaggaaaggtaggttcaccatctcaagagatgattacaaagactnactgtatctgacaaatgaacagacctagaaaaccgnggacacggccgtntattattggttgtaagaacaaaaggngttaggaatggtggtgggtagcgtggngtaaccg

SEQ ID NO: 360972 - DNA, 752 bp, Homo sapiens
  misc_feature: GZ8MTXP01CJMMM.21.4.A04.1.454.CMB.2.raw
  modified_base (194)..(194): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtncagctggtggagtcgtgggggatacgttggtccagccgtgggacgggtccctgacgactctcctggtcgcagtcctctgcctatccaccttcagtcgaaccaacaacagtcggaccgtcggggtccccgaccgacgggtccgtaccgggaaggggggaacgggggccgttagggggagggttcgggggtaccgggtaccggttaagttaaacggaaaacgggtaaacgtactaaaacgtagtttaaacgaaaagtaacgaaggaaacgtaccgggcgtaccgtgtagggtaaaggaaaacggggtacggttaccaacccgtagttaccgtaacgaaaggtaagtattaacggaaacttaaacgaaaacgtaacctactaaccgttagggttaactaccgtaagaacctaaaagtaccgaaacgaacgtaacccgtaaacggaaaacccgggaggaaccgtaccgggtaacgttaagttaacgttagttaggtaaggtaacgaaaagaaaaggttggttaagggtagttcgggttagggtaggttagtcgttggtaacg

SEQ ID NO: 360973 - DNA, 733 bp, Homo sapiens
  misc_feature: GZ8MTXP01CKCTR.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttggttttccttgttgttatttagaaggtgtcagtgtgagtgcagcgtggtggagtcggtgggggagtcgttggtccgaggtccggttcggggggtccctggagtacgtcctccgtgtgtcggcctcgtggtattacgtaaagtttaactaccgttagttggatgagtcgtcgggtcccgccgaggccgtaccggaagggggacggggtcgtggggaggtgggggtcgaaccaaacgaaagtaaagggaaagtagtaagggaaagtaagaaagtaaaaagttgtaggtaacggtactcgtagggtacggaacgggccgtatacgaccattctacgaggaacgaaccgaacgaacctaaagtaacctactaacgtttatccgtaagtaactaaacgttaggtaaacgttacggtcccgtaagggaaagtaaccggtaaccggaaacggtacccgtacgggtaccttagggttaagtttacgttaaaccgtgggttacggaacggttaaggaaacggtagttaggggacgggttaggggtaaggggtgaacggtacgacggttcccgtggttaacccggtttaagg

SEQ ID NO: 360974 - DNA, 722 bp, Homo sapiens
  misc_feature: GZ8MTXP01B69KU.21.4.A04.1.454.CMB.2.raw
  modified_base (261)..(261): a, c, t, g, unknown or other
  modified_base (268)..(268): a, c, t, g, unknown or other
  modified_base (292)..(292): a, c, t, g, unknown or other
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagtcttggttttccttgttgttatttacaaggtgtccagtgtgaggtgcagcgtggtggagtcgtggggatacgttggtccagccgtggacggtccctgacgtactctcctgtcgcncgtcctntgctatcactcagtcaccacaacngtggacgtcgggtacccnccgaggccgtacggaagggggaacggggtcgtaggggacgggttacggggttccggtaccgttaaagttaaaccggaaacgggaaacgtaccgtaaacgtaagtaaccgaaaagttaaccgaagtaaacgtacgggcgtacgttcgtaagggtagaaaacgggtacgttaccaccgtatacgtacaaaggtaagtactagtaaacttacgaaaacgtaactctaacgttagggtactacgtagtaaacaaaggtacaaaccgacgttaaccccgaaaggaaaaccgtcggaaaccgtaccgggtaactttagggttaatttaacgggttcggtaaaggtaaacgaaacggttaaaaggttggttaagggacgtttaagggttcgggagggttaccctggtttaagtaacccg

SEQ ID NO: 360975 - DNA, 627 bp, Homo sapiens
  misc_feature: GZ8MTXP01CE3BF.21.4.A04.1.454.CMB.2.raw
  modified_base (214)..(214): a, c, t, g, unknown or other
  modified_base (279)..(279): a, c, t, g, unknown or other
  modified_base (288)..(288): a, c, t, g, unknown or other
  modified_base (301)..(301): a, c, t, g, unknown or other
  modified_base (343)..(343): a, c, t, g, unknown or other
  modified_base (348)..(348): a, c, t, g, unknown or other
  modified_base (593)..(593): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggaatcaccatggagtttgggctgagctgggttttccttgttgttatttacaaggtgtccagtgtgagtgcagctggtggagtcgtggggganacgttggtccagcctgggacgggtccctgagactctcctgtgcagcctctgctatcacttcagtnaccacaacntggactgggtccncaggctcgaggggaggctggagtggcgcgtatacgaaggaanctaanagttacaagttaacaagaaacgtaccgggcgtcgtctagggtaaggaaaacgggtacggttaccaacccgtatccgtaacgaaaggtagtaattggaaattacaaaagtaactactaacgttaggtacttacgtacgaaccaaaagtcgaaaccacggtacccgtaaacggaaaaacccggcggaaaccgaccgggtaaccgttagttaagtttagttaggtaagggtaagaaacgttaaaaggnggtggagttggtgggtaggttatcgttgtaaccg

SEQ ID NO: 360976 - DNA, 889 bp, Homo sapiens
  misc_feature: GZ8MTXP01CZRJV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcacatggagtttgggctgagctgggttttccttgttgttatttacaaggtgtcagtgtgaggtgcagcgtgggtggagtcgtgggggagtacttggtccagccgtgggacgggtccctgacgactctcctgtgcagcctctgctatcaccttcagtacgaaccaacaaacagtcggaccgtcggggtcccaccgaggtccgtaccggaagggggaacggacgtcggtagggacggttcgggggtacccgggtaccgttaaacgtttaaacccgaaaaggggtaaaacgtaccgttaaaaacgtaacggttttaaaaaaccgaacggttaaccgaaacgggtaaaacgttaacccgggggaccggtaccgggtttaccggttaaggggtaaagggtaaaaaacggggttaaacggggtttaacccgaaaccccgtaaatttaccgttaaacgaaaagggtaagggtaaattaagggtaaactttaaacgaaaaaaacggttaaacccgttaaccgtaaactttacgggtttaaacttaccgttaacgggaaacctaaaagttacgggaaaactaaccggtaaccgtaaaacgggaaaaacccggtagggtaaacccggaacggggttaacccggttaggttttaaagttaacgggttttacggtaaaggggtttaaaaggaaaacggttaaaaaaggggttaaggttaaggggtaaggtttacggggttagggggtttacgggttaacgggttcgtttaacggg

SEQ ID NO: 360977 - DNA, 903 bp, Homo sapiens
  misc_feature: GZ8MTXP01BAK7P.21.4.A04.1.454.CMB.2.raw
  modified_base (327)..(327): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacaggtgtcagtgtgaggtgcagcgtgggtggagtcgtgggggagtacgttggtccagccgtgggacgggtccctgacgtacctcctccgtggtcgcacgtccctctgctactccaccttcagtacaaccacaacagtcggacgtcggggtcccnccgaggccgtccggaagggggaacgggggtcgtagggggtaggtcgggggtaccgtaccggttaaagttaaaccgaaaaggggtaaaacgtacttaaaacgtaacggtttaaaccgaaaaggttaaaccgaagggtaaaacgtaccccgggggtaacgggttaccgggtttaaccgttaagggggtaaaacggggtaaaaaaccggggtaaacggttttaccccaaacccgtaagttacctaaacggaaaggtaaacgtaaagttaggtaaaactttaaacccgaaaaaaggtacccctttacgtaaaccgtttaggggtaaacctttcggtaaacgtaaaccgttaaaaagtaccggaaaacccgttaacggtaaaccccggttaaaacggggaaaaaaccccgggttaagggaaacccccgtaaaccgggggttaacccggttttaaagtttaaacggtttaaaggtttcgggggtaaaagggtaaaaccggttaaaaacgttaaaaggggttgggttaacggggttagttaacgggggttaggggttaggttaacgtcggttaacggtaaccg

SEQ ID NO: 360978 - DNA, 631 bp, Homo sapiens
  misc_feature: GZ8MTXP01CA1S3.21.4.A04.1.454.CMB.2.raw
  modified_base (269)..(269): a, c, t, g, unknown or other
  modified_base (283)..(283): a, c, t, g, unknown or other
  modified_base (291)..(291): a, c, t, g, unknown or other
  modified_base (305)..(305): a, c, t, g, unknown or other
  modified_base (595)..(595): a, c, t, g, unknown or other
  modified_base (602)..(602): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgagtgcagctggtggagtcgtgggggagacgttggtccagcccgtgggacgggtccctggacgtactcctcctgtgcagcctntgcatcactcagtnaccacacntggacctggggccncaggcctccggaggggacgggctggaggtcgggtacgccgtaattacgaaacggaaagtcgtaaacgtagttaacaaggttaacaagtaaacgtaccgggcgtgtacctgggtaagaaagggtacgttacaacctatacgtacgaaaggaagtacgttagaactttaaccaaaagtaacctacgtaaccttggtaactctagaacaaaagtcaaacgagaccgtaacgaaaaccggacgaacgtacggtaacgtagttagttagttaggtaaggtacgaaagttaaaagngtaaggngttggtaggtgggttagtcgttggtaacg

SEQ ID NO: 360979 - DNA, 673 bp, Homo sapiens
  misc_feature: GZ8MTXP01D8CIV.21.4.A04.1.454.CMB.2.raw
  modified_base (203)..(203): a, c, t, g, unknown or other
  modified_base (213)..(213): a, c, t, g, unknown or other
  modified_base (242)..(242): a, c, t, g, unknown or other
  modified_base (291)..(291): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaaggggaaancgccaccctntcctgcagctccagccagaatatccaganctactacatagcctggaccagcagagcctggccaggcctccgagttccnatctatcgccttcgggacccacggacggccctagtcggacactcccgaagtaccgtaggttccaaggtcggactagggtaacgggtctgggggaactaaagggttccctttacaccttctactaattacctaagttacggacgacgtacgtggtaacggtccttaaggaacttagttccgaagttaaagggttcgttaaacctttagtacgtacgtaggaacttaagttaggttaacggtaaacgtttcctaccgttcgttacggttccggttaaccggaaccgaaacggggttaaaccgaaaggttaaaccgaaaaggttacgttaaaacgaaccgtttggacgtaacggttacacccgttaacgtaactttcgttaaccg

SEQ ID NO: 360980 - DNA, 724 bp, Homo sapiens
  misc_feature: GZ8MTXP01CJQTN.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggttgagcttgggttttccttgttgttattttacaaggtgtccagtgtgaggtgcagcgtggtggagtcgtggggggagacgttggtccagccgtgggacggtccctgagactctcctgtcgcacgcctctgctacttcaccttcagtcgaccacaacagtggacgtcgggtcccgccgaggcctaccggagggggaacgggggcgtggggaggtcgggggtccggaccgtaagttaacgaaaggaaacgactaaacgagttaacagtaaacagtaacgtaccgggcggcgttacgtagggtaaggaaaacgggtaacggttccaaccgtattaccgtacaaaggagaagttagtaatttaaccgaaaacgtaacctacgaacttgttaaactccgttaaggaacctaaaagtacgaaaccgtacgaacccgtaaacggaaaaacccggacgggaacccgaaaccggggttccgttaaagtttaagtttaaggtttaggttacgggttaaaacgaagttaaaaagggttgggttaggggtaagttgggttaaggggtaggtaggttcggttggaacggtaaccg

SEQ ID NO: 360981 - DNA, 845 bp, Homo sapiens
  misc_feature: GZ8MTXP01EPA82.21.4.A04.1.454.CMB.2.raw
  modified_base (218)..(218): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagcgttgggttttccttgttgttattttacaaggtgtccagtgtgaggtgcagctggtggagtcgtggggganacgttggtccagcccgtgggagggtccctgagactctcctgtgcagcctctgctattcaccttcacgtcgaacccacaaacagtcggacgtcggggtccccgaccgtagggccctaccggaagggggtaacgggggtcgtagggggaagggttcgggggtaccggtacccgttaaagttaaacccggaaaggggtaaaaccgtaccgttaaaacgtaggtttaaaccgaaaggttaaacccgaaagggtaacgtaaccggggtccgtaccggttcgtaagggttaagggaaaacggggttaacgggtttacccaaaccgtaacttaccgtaaacgaaaggtaacggtaaactttagggtaaactttaaccgaaaaaagttaacccctacgtaaacctttaggttacttacgttaaggaaacctaaaaggttacgaaaacccgtacggaaccccgttaaaacggggaaaaaccccgtgggaaacccgtaccgggtcccggttaagtttaaacgttttaggttacggggttaaagggtaaacgtaaaaaccgttaaaagggttgggttaccggggtaaagtttcgggttaaggggtcggggttaacgttcgtttaaggcggtaaacccg

SEQ ID NO: 360982 - DNA, 684 bp, Homo sapiens
  misc_feature: GZ8MTXP01BP48Q.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacgttggtccagccgtggacgggtccctgagactctcctgtgcagcctctgctatcaccttcagtcgaaccacaacagtcggaccgtcggggtccccgccgaggccgtaccggagggggaacgggggccttggggacggtcgggggtccggaccggttaaagttaaccgaaaagggaaaacgtactaaaacgtagtttaaccaaacgttaaacaaggtaaacgtaccggggcgtaccgttcgtagggtaggaaaacgggtacggttacaacctatctaacgaaagagtatagaacttacaaaagtactacacttaggtaactcgtagactaaagtacgaaacacgaacccgtaacggaaaacccggtaggaaccgaccgggtaaccgttagttaagtttaagttgggtaaggtaagaaacgttaaaaggttggtaaggtaagtggttaggtggttagtcgttggtaacg

SEQ ID NO: 360983 - DNA, 663 bp, Homo sapiens
  misc_feature: GZ8MTXP01EXDH3.21.4.A04.1.454.CMB.2.raw
  modified_base (218)..(218): a, c, t, g, unknown or other
  modified_base (315)..(315): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagctgggttttccttgttgtttattttacaaggtgtccagtgtgaggtgcagcgtgggtggagtcgtggggganacgttggtccagccgtgggacggtccctgagtctctcctgtcgcagcctgtgctatccaccttcagtcgaaccacaacagtggacctcggggtcccnccgaggcctacggaagggggaacggggctggggaggtcggggtccgaccgttaagttaacgaaacggaactactaaacgtagttaacaaagtaaccaaggaaactaccgggcgtacgtacgttagggaaaggaaaacgggtagttccaacgtatctacgaaagagtatagtaacttaaacgaaaagtacttacaacgttagggtattacgtaagaactaaagtacgaaacgtacgaaccgtaaacgaaaacccggtaggacccaacgggtcttagttaagttagttaggtagtaaagaaacgaaaaggttggtaaggtagttggtagggtggttatcgttggtaaccg

SEQ ID NO: 360984 - DNA, 741 bp, Homo sapiens
  misc_feature: GZ8MTXP01CNN3H.21.4.A04.1.454.CMB.2.raw
  modified_base (267)..(267): a, c, t, g, unknown or other
  modified_base (314)..(314): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggatacttggtccagccgtgggacgggtccctgagactctcctgtgcagccctntgctatccaccttcagtcaaccaacaacagtcggactcggggtcccnccgagggcctaccgggagggggaacgggggtctaggggaggtcgggggtccgacgttaagttaacgaaagggaaacgtacgtaaacgtagttaaccaaagttaaccaaggtaaactaccgggcgtacgtcgtaggtacgggaaaagggtacgttcaaaccgtatctaacgaaagtagtaatagtaaacttaaccaaaaagtacttacaacgtttgggttaactcgttaagaaactaaaagtacgaaaccgtaacgtacccgtaaacggaaaaacccggtaggaaaccggttacccggggaaccgttttagttaaacgttttacgttagggttaaacgggttaagaaaaccggttaaaaagggttcgggttaaggggtaagtttaagggggttaggggttagggttaacgtccggttaaggtaaccgg

SEQ ID NO: 360985 - DNA, 582 bp, Homo sapiens
  misc_feature: GZ8MTXP01A16J3.21.4.A04.1.454.CMB.2.raw
  modified_base (306)..(306): a, c, t, g, unknown or other
  modified_base (363)..(363): a, c, t, g, unknown or other
  modified_base (368)..(368): a, c, t, g, unknown or other
  modified_base (400)..(400): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcacatggagtttgggctgagctgggttttccttgttgttattttacaaggtgtccagtgtgaggtgcagctggtggagtcgtgggggagacttggtccagccgtggaggtccctgagactctcctgtgcagcctctgcatcaccttcagtacgaccacaacagtcggactcggggtcccnccgaggcctccggagggggagggctggaggtgggtcggaccgtataccgaaggaacnctaanagttacaaagtacaagaagtaccgggcacgtntggtaagaaacggtaggttccaaccatactacaagagatagattacaaaagactacactgtatctgaacaaatgaactagacccgtaagaaaacccgaggacgaccggtcgtagttattagttggtagtaagaacgaaaaggttggtaaggaagttgggtagggtgggagtcgttggtaacg

SEQ ID NO: 360986 - DNA, 520 bp, Homo sapiens
  misc_feature: GZ8MTXP01EAVPS.21.4.A04.1.454.CMB.2.raw
  modified_base (215)..(215): a, c, t, g, unknown or other
  modified_base (255)..(256): a, c, t, g, unknown or other
  modified_base (258)..(262): a, c, t, g, unknown or other
  modified_base (276)..(276): a, c, t, g, unknown or other
  modified_base (278)..(278): a, c, t, g, unknown or other
  modified_base (287)..(287): a, c, t, g, unknown or other
  modified_base (291)..(291): a, c, t, g, unknown or other
  modified_base (300)..(300): a, c, t, g, unknown or other
  modified_base (302)..(302): a, c, t, g, unknown or other
  modified_base (329)..(329): a, c, t, g, unknown or other
  modified_base (340)..(340): a, c, t, g, unknown or other
  modified_base (342)..(342): a, c, t, g, unknown or other
  modified_base (354)..(354): a, c, t, g, unknown or other
  modified_base (357)..(357): a, c, t, g, unknown or other
  modified_base (376)..(376): a, c, t, g, unknown or other
  modified_base (380)..(380): a, c, t, g, unknown or other
  modified_base (385)..(385): a, c, t, g, unknown or other
  modified_base (387)..(387): a, c, t, g, unknown or other
  modified_base (389)..(389): a, c, t, g, unknown or other
  modified_base (394)..(394): a, c, t, g, unknown or other
  modified_base (398)..(398): a, c, t, g, unknown or other
  modified_base (415)..(415): a, c, t, g, unknown or other
  modified_base (421)..(421): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctctgtgcnncnnnnncactcagcacacanangagtgcgcncgcncgaggaggngnggagtggcgcgtactacgaacgaaganaacagtacaananaagaagacgcgngtntagtagaagaagtacacanacanaaganananataanaaanaacacactagtatatanacaaanagaacacgacaacgaaacgaacgacgacgaacgtagttattattagtagtaagaaagaaagaagtaagtagtaagtaggtaggttagtaacgttgtaag

SEQ ID NO: 360987 - DNA, 705 bp, Homo sapiens
  misc_feature: GZ8MTXP01A9J4Q.21.4.A04.1.454.CMB.2.raw
  modified_base (260)..(260): a, c, t, g, unknown or other
  modified_base (267)..(267): a, c, t, g, unknown or other
  modified_base (281)..(281): a, c, t, g, unknown or other
  modified_base (317)..(317): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgttattttacaaggtgtccagtgtgaggtgcagctgggtggagtcgtgggggatacgttggtccagccgtggacggtccctgagctctctgtcncagcctnagctatcacccttnagtcgaccacaaactgtgggtacctggggtaccccncgtacggccgtaccggaaggggggaacgggtctaggggagggtcggggtaccggacgttaaagttaacgaaacgggaaacacttaaacgaagtttaccaaaggttaacaagggaaactaccggggcgtacgtctaggggttaaaggaaaacgggtacggttaccaacctagtacctacgaaagtagtataggtaattaaccgaaaagtacctataaccgttaggtaaccttgtaacgaaccttaaaagccggaaaactacggaacccgtaaacggaaaaccggtacggaaccgaaccggtaaccgttagttaagttacgttaggtaaacggtaacaaagttaaaggaggtggtagttaagggcggttaggttagtaacgttggtaacg

SEQ ID NO: 360988 - DNA, 757 bp, Homo sapiens
  misc_feature: GZ8MTXP01EZ37J.21.4.A04.1.454.CMB.2.raw
  modified_base (267)..(267): a, c, t, g, unknown or other
  modified_base (633)..(633): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacaaggtgtccagtgtgaggtgcagctggtggagtcgtgggggagacttggtccagccgtgggacggtccctgagtactctcctgtcgcagcctntcgctatcaccttcagtacgaaccacaaacagtcggacgtcggggtccccgccgaggccgtaccggaagggggaacgggggtcgtggggagggtcgggggtaccggtaccggtaattaaccgaaaggaaacgactaaacgtagttaacgaaagttaacaaggtaaacgtacgggccgtacgttcgtaggtaacggaaaagggtacgtttaccaacctagttacctaacgaaagggtaagtagttaaggtaactttaaaccgaaaaacgtaacctttaccggtaaacctttagggggttaaacttacggtaacgaaacctaaaagtaccggaaaccgtaacggaccccgttaaaggaaaaacccggngggaaacccgtaacggggtaaccgttaagtttaagttagggttgtaaaggggttaaacaaaacggttaaaagggttaggtgggtaacgttgggtaggggttaggttagtccgttaaggtaaccg

SEQ ID NO: 360989 - DNA, 630 bp, Homo sapiens
  misc_feature: GZ8MTXP01CXOD9.21.4.A04.1.454.CMB.2.raw
  modified_base (212)..(212): a, c, t, g, unknown or other
  modified_base (253)..(253): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgttagttatttacaaggtgtcagtgtgagtgcagctggtggagtcgtggggganacttggtccagcctggacggtcctgagactctcctgtgacncgctctgtactactctactacgtacgtacgaaccaacaacgtagtaggtacgtcggtccgcgacgacgtacggagggagggtcgtggtaggtcggtcggtacgtaacgtaacgaaacggaaacgtaacgtaacgtaacgtaacgtaaacgtaacgaagaacgtacggacgtacgtacgtagtagaaaggtacgtacgtactacgtactacgaagaagtatagtaagtaacgtaaacgtaactactacgtacgtaacgtacgtagtaactaaagtaacgaacgaacgaacgtaacgtaaacgaacgacgacgtaacgtagttagttagttagtagtaagaaagaagttagtaagtagtggtggtaggttagtgttgtg

SEQ ID NO: 360990 - DNA, 740 bp, Homo sapiens
  misc_feature: GZ8MTXP01AZVCH.21.4.A04.1.454.CMB.2.raw
  modified_base (192)..(192): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtncagctgggtggagtcgtgggggagtacttggtccagccgtggagggtccctgacgtactctccgtgtgcacgtcctctgctactccaccttcagtcgaaccaacaacgagtggtaccgtcggggccccgacgacgggccctaccgggaggggggaagggtccggtaggggagggttcgggggtcggtaccgtaagttaaacgaaacggggaaactacgtaaagtacgttaacgaagtaaaccgaagaacgttaaccggggcgtcggtctagggtaaggtaaacgggtacgttaccaacctaatctacgaaaggtagtagtaaggtaacttaacaaaacgtaactactaacgttaggtacttacgtaacgaactaaagtaacgaaacgtaccggtaaaccgtaacgggaaaaaccggtagggtaaccggtaaccgggtccggtttaagttaagttttaggttaggtaaggggtaagttaaaagttaaaagggttgggttaagggtaggtttggggaggggttacggttacgtcgggttggttaaccggg

SEQ ID NO: 360991 - DNA, 561 bp, Homo sapiens
  misc_feature: GZ8MTXP01B8B66.21.4.A04.1.454.CMB.2.raw
  modified_base (199)..(199): a, c, t, g, unknown or other
  modified_base (294)..(294): a, c, t, g, unknown or other
  modified_base (390)..(390): a, c, t, g, unknown or other
  modified_base (409)..(409): a, c, t, g, unknown or other
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcacctgtctttgctccgaggggaaangccaccctctcctgcagcctccagccagaatatccagagctactacatagcctaggtaccagcagaacgcctggccaggcctcccgaggttcccncgatctatgcgttcgggaccccacgcgggcccacgtcggaccactcccgagactacggttcaggtggcaggtgggtctgggacaggtcttcactcncatcatagcagactggacnctagtaacgtatttcgctagttgttactttacgtgtacagtactaggtagtaggtaacgttctaccctgtcgttcggtcggacgttaagggacttaagggtaacaagttacgaaacgttagtggtacggtctcggcttacgtcgttgttccg

SEQ ID NO: 360992 - DNA, 583 bp, Homo sapiens
  misc_feature: GZ8MTXP01BBH48.21.4.A04.1.454.CMB.2.raw
  modified_base (216)..(216): a, c, t, g, unknown or other
  modified_base (265)..(265): a, c, t, g, unknown or other
  modified_base (304)..(304): a, c, t, g, unknown or other
  modified_base (332)..(332): a, c, t, g, unknown or other
  modified_base (391)..(391): a, c, t, g, unknown or other
  modified_base (467)..(467): a, c, t, g, unknown or other
  modified_base (482)..(482): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccaggcctggacgggtccctgagactctcctgtgcagcctntgctatcacctcagtgaccaacacatggactcgggtccncaggcctccggaagggagggggctgggngtggggcgacgttatacaaggaagctaacagtacaagtacaagaactacgggcgtcgtntaggtacgaaaggacggttacaaccagtactacgaaaggagtatagattacgaaaagaactacactggtactgtanaacgtaaatgaaacngtaacccgtagaaaacccggaggaacacggcgttaagttataagttcgtaagggtagaaacgaaaggcgtaagagtgggtaagtggttagcgttggtaacg

SEQ ID NO: 360993 - DNA, 640 bp, Homo sapiens
  misc_feature: GZ8MTXP01BIIJK.21.4.A04.1.454.CMB.2.raw
  modified_base (218)..(218): a, c, t, g, unknown or other
  modified_base (262)..(262): a, c, t, g, unknown or other
  modified_base (400)..(400): a, c, t, g, unknown or other
  modified_base (431)..(431): a, c, t, g, unknown or other
  modified_base (455)..(455): a, c, t, g, unknown or other
  modified_base (591)..(591): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagctggtggagtcgtggggganacttggtccaggccgtgggacgggtccctgagactctcctgtcncagcctctgctatcaccttcagtcgaccacaacagtcggactggggtccgccgaggcctcggagggaagggggctgggagtgggcgcgtagtacgaaggaaagctaacagttacaaagtacaagaatacgggcgcgtntggtagaaaggagttcactatctacaaaganatagtaacttacgaaaagtactanaccttgggtaaactcgttagaacctaaatacgaaacacgaaccgtaacggaaaaacccggacggaaaccgtaccgggtaaccgttaagtttaagttaaagtttgggtaaagggttaaacgaaacggttaaaaaggnggttaagggaaagtttcgggtaggggttcgggttaatcgttggtaaccg

SEQ ID NO: 360994 - DNA, 786 bp, Homo sapiens
  misc_feature: GZ8MTXP01BLLL3.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagcgtggtggagtcgtgggggagacgttggtccagccgtgggacgggtccctgacgtactctcctgtcgcagcctctgctactccaccttcagtacgaacccaacaacagtcggaccgtcggggtccccgaccgaggcccgtaccggaagggggaacgggggcgtgggggaggtcgggggtaccggaccgttaagttaaccgaaacgggaaacgtacgtaaacgtagttaacaaaggttaaccaaggaaacgtaccgggcgtaccgtagtagggtaagggtaaaacgggtacggtttccaaacccgtagttacccgtaagaaaaggtacgtaaattacggtaaacttaaaccgaaaaacgttaccctacgtaacctttaggggtaacttaccgtaaaggtaacctaaaaagtccggaaaacgtaacccggtaacccgtaaaacgggaaaaaccccgggaggtaaacccgtacccggggtaaccgtttaagttaaacgtttaggttagggtaacgggtaaacgaaaacggttaaagggttagggtaaggtaaggttcggggttggggtacgggttaacgtgttcgggtaaccg

SEQ ID NO: 360995 - DNA, 690 bp, Homo sapiens
  misc_feature: GZ8MTXP01EW83C.21.4.A04.1.454.CMB.2.raw
  modified_base (218)..(218): a, c, t, g, unknown or other
  modified_base (258)..(258): a, c, t, g, unknown or other
  modified_base (264)..(264): a, c, t, g, unknown or other
  modified_base (269)..(269): a, c, t, g, unknown or other
  modified_base (278)..(278): a, c, t, g, unknown or other
  modified_base (287)..(287): a, c, t, g, unknown or other
  modified_base (305)..(305): a, c, t, g, unknown or other
  modified_base (370)..(370): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagctggtggagtcgtggggganacgttggccagccgtggacggtccctgagtctctcctgtntgcctntgctnttcaccttnagtcaccanaacagtggactgggaccnccgaggccgtacggaagggagggggctagggaggtggggtcgaccgttagtaaccgaaggaaacnctaagtagttaacagtaaacagaacgtacgggcgtcgtacgtaggtaaggaaaggtcgttacaaccgtagtctacgaaaggactagtacgtaaattaaccggaaaatacctacaaacttggtaacgttctaacgggaaactaaagtaaccgaaactaccggtaaccgaaaacggaaaaccggtagaacccgtacggggaccgtttaagttaaagtttacggtagggtttaaaggaaccggtaaaaattaaaaggggttgttggggtaaagttgggttaaggggttaaccgggtagttcgttaaaccgggttgtaaacccg

SEQ ID NO: 360996 - DNA, 718 bp, Homo sapiens
  misc_feature: GZ8MTXP01CMX6J.21.4.A04.1.454.CMB.2.raw
  modified_base (313)..(313): a, c, t, g, unknown or other
  modified_base (506)..(506): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggtagtttgggctgagtcgttgggttttccttgttgtttattttacgaaggtgtcagtgtgaggtgcagcgtggtggaggtcggtgggggagacgtttggtccagccgtgggacggtccctgacgtactctccgtgtcgctacgcctctgctaacttccaccttcagtacgaaccaacaacngtacggacgtcgggtccccgacgacggccgtaccgggaagggggaacggggtcgtggggtacggtcgggggtaccgtaccgtaaataacggaaaggaaaacgtactaaacgtagttaacaagtaaacgaacgtaacgtcgggcgtacgtacgtaggtaagggaaaggtacgtacaactatactaacgaagtanagtacgtaattaacgaaaagtactacacgtagttactcgtaagaacctaaagtacgaaacgtacgaacccgtaaacggaaaccggtaacgggaacccgtaacggggtccgttaagttaagttaaagtttgggaaggtaaacgtaaaggaaaaggttgggttaagggtaagttgggttaacggttagggtacgttagttaaggttcgtaaccg

SEQ ID NO: 360997 - DNA, 762 bp, Homo sapiens
  misc_feature: GZ8MTXP01B5LI8.21.4.A04.1.454.CMB.2.raw
  modified_base (216)..(216): a, c, t, g, unknown or other
  modified_base (265)..(265): a, c, t, g, unknown or other
  modified_base (277)..(277): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagctgggttttccttgttgttattttacaaggtgtccagtgtgaggtgcagctggtggagtcgtggggganacttggtccagccgtgggacggtccctgagactctcctgtgcacgcctntgctatcacttnagtcgaccacaacagtggacgtcgggtccgccgaggcctaccggaggggacgggctgggaggtcggggtacggccgttaagtaccgaaggtaaacgcctaaacgagttaaccagtaaacaggtaacgtacgggcgtcgtacgtagggtaggaaaggggaactttccccacgtaaacttccgtaacggaaagtaagtaacgttggaaactttaaaccgaaacgggaaaccttccgtaaagttaccggttagttaacgttcggaaacctaaagtaaacgaaacccgaaccggttaccgtaaaacggggaaaaacccgtaacgggacccgtaaaccggggttcccgtttaagggttaactttttaaaggggttccggttaaagggggtttaaaacgaaaccggttaaaaaaagggttcgggttaggggttaattagggggtttcgggttagggggtacttaacccggttgggtttaaccggaaacccg

SEQ ID NO: 360998 - DNA, 647 bp, Homo sapiens
  misc_feature: GZ8MTXP01BP9FK.21.4.A04.1.454.CMB.2.raw
  modified_base (371)..(371): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgtttgttattttacaaggtgtccagtgtgaggtgcagctggtggagtcgtgggggagacgttggtccagcctgggagggtccctgagactctcctgtgcagcctctgcatcaccttcagtgaccacaacagtggacctggggtcccgccaggctccgaggggaggggctgggagtggggtacgccggtaattacgaaaggaaagctaaanagttacaaagtacaagaaatacgggcgcgtactggtaggaaagtaggttaccacatcgtacaagagatgaatttacaaaagtacgtacaacttggtaaattcgtagaacctaaatagaaaccgaagtaaccccgtaagaaaaaacccggacgaaccctaacggggaaccccttaaggttaagtttaacgttaggttacgggttaaaggaaaaccgttaaaaaggagggttaagggtaacgttgggttaggtagggttagaaccgtttggtaaccgg

SEQ ID NO: 360999 - DNA, 761 bp, Homo sapiens
  misc_feature: GZ8MTXP01EXDJB.21.4.A04.1.454.CMB.2.raw
  modified_base (281)..(281): a, c, t, g, unknown or other
  modified_base (296)..(296): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctggattttccttgttgttattttacaaggtgtccagtgtgaggtgcagctggtggagtcgtgggggatacttgggtccagtcctgggacgggtccctgagtactctccgtgtgcagcctctgcattcaccttnagtcgaaccacaacngtcggacgtgggtcccaccgaaggccgtaccggaaggggggaacgggggtccttagggggacggttcggggtcccggtaccgtaagttaaaccgaaaggggtaaaacgtctaaaacgaacggtttaaacaacggttaacgaaggaaaacgttcccgggcgtaccggttacgtagggtaaacgggaaaagggtaacggttaccaaaccctaacgttaccgttaaccgaaaaggtaacgtaacgtagggtaaactttaaccgaaaaaggttaaaccttaccgtaaacgttaggttaactacgtacggtaaacctaaaagttacgaaacgtaacgtaccgtaaacgggaaaaacccggagggaaacccgaacgggtacccgttaggtaaatttaacgtagggttaaggttaaacgaaacgttaaaaaggtggtaggtaagttgggtagggttgttaaggttctaaggg

SEQ ID NO: 361000 - DNA, 511 bp, Homo sapiens
  misc_feature: GZ8MTXP02JRA3I.21.4.A04.1.454.CMB.2.raw
  modified_base (201)..(201): a, c, t, g, unknown or other
  modified_base (290)..(290): a, c, t, g, unknown or other
  modified_base (397)..(397): a, c, t, g, unknown or other
  modified_base (415)..(415): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttccnatctatgctgggtcccagagggcccacgtggcatcccagcaggttcagtgcagtggtctgggacagacttcactctcatcattagcagactgagcctgaagattcgnagtgtattactgtcaganagtagtagtagtactactcgtcgtcgtcggtacgaacggaacgaaggtaagtaacgtaacgaacgaacgtaagtagtacgtacgacacactactcg

SEQ ID NO: 361001 - DNA, 523 bp, Homo sapiens
  misc_feature: GZ8MTXP02JNC32.21.4.A04.1.454.CMB.2.raw
  modified_base (200)..(200): a, c, t, g, unknown or other
  modified_base (288)..(288): a, c, t, g, unknown or other
  modified_base (374)..(374): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctccaggttccnatctatgctgggtccccagacgggcccacgtggccatccccagacaggttcaggtgcaggtgggtctggggacagacttcacttcncatcattagcagacgtggagcctagaagtatttcgactagtgtattactgtcagactagtatggtagttcactctgtcgttcggacgaagggacctaaaggtacgaaatacgaaacgtacgtggtacgacgtacgacacctagtctacg

SEQ ID NO: 361002 - DNA, 517 bp, Homo sapiens
  misc_feature: GZ8MTXP02JKVHF.21.4.A04.1.454.CMB.2.raw
  modified_base (200)..(200): a, c, t, g, unknown or other
  modified_base (292)..(292): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggaangccacctctcctgcagctccagccagaatatccagagctactacatagcctggtaccagcagaagcctggccaggcctcccgaggttccctnatctatgctggggtccccacgagggcccacgtggcactcccagcaggttcagtgcaggtggctggggacaggacttcactctcatcattagcagactggagcctagaagtatttcgctagtgttattactgttacagcagtatggaagttcaccttcgtgtcggttcgccgaagggaccaaggtacgaacgtacgaaacgaacgtgtcgactcgcaccgatctcg

SEQ ID NO: 361003 - DNA, 552 bp, Homo sapiens
  misc_feature: GZ8MTXP02GIDLF.21.4.A04.1.454.CMB.2.raw
  modified_base (212)..(212): a, c, t, g, unknown or other
  modified_base (276)..(276): a, c, t, g, unknown or other
  modified_base (299)..(299): a, c, t, g, unknown or other
  modified_base (380)..(380): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggtatttacaaggtgtcagtgtgaggtgcagctggtggagtctgggggganacttgggtccagcctgggagggtccctgagctctcctgtgcagcctctgcattcaccttcagtnaccacaacatggactggggtccnccaggctccgaggggaggggctggagtggggtcgcgtatacaaggaagctaacagttacagtacagaaactacggcgcgtntgaggaaaagggaaggttcaacccatcctaacaagagatacgtaataacaaacaactactactagtatactagacaatagaacacgacgaacgaaacgaacgaacgacggacgtagtattagttagtaggtagaacgaaagaagtaagtagtagtaggtaggtagtcgtgtg

SEQ ID NO: 361004 - DNA, 670 bp, Homo sapiens
  misc_feature: GZ8MTXP02J4NUW.21.4.A04.1.454.CMB.2.raw
  modified_base (476)..(476): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggaggtcttggtccagccgtgggacgggtccctgacgactctcctgtgcagcctctgctattcaccttcagtcgaaccacaacagtgggacctcggggtccccgccgaagggcctaccggaagggggtaacggggcttaggggaggtcggggtacccggtacccgtaaattaaccgaaaggaaaacgctaaaacgtagttacagttacagaacgtaccgggcgcgtactaggtaagaaaggaacgttaccaacctataccaanaagagtatacgtaactaaacgaaaacgtactactaactgtaactacgtagaactaaacgtaacgaaaccgaacgaaccgtaaacggaaaaccggaaaccggaaccggaaccggtacggtagttagttaagttagtaggtaacgaaacgaaaagaaggtaaggtagtaggtagggtaggtacggtacgtagtacg

SEQ ID NO: 361005 - DNA, 544 bp, Homo sapiens
  misc_feature: GZ8MTXP02G6LS6.21.4.A04.1.454.CMB.2.raw
  modified_base (301)..(301): a, c, t, g, unknown or other
  modified_base (439)..(439): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccnccaggctccgaggggaaggggctgggagtggggtcggccgtattacgaaggaaagctaaacagttacagtacagaatacggcgacgtctgtagaaagggaagttcaccgatctcaaagagatgattacaaaagactanactgtatctgacaaatgaacagacctagaaaaccgagacaacggcgtagtattattgaggtagaacgaaagaggtgtaagtggtaggtaggtacggcgtagtacg

SEQ ID NO: 361006 - DNA, 607 bp, Homo sapiens
  misc_feature: GZ8MTXP02IE309.21.4.A04.1.454.CMB.2.raw
  modified_base (303)..(303): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacagtggactggggtccnccaggcctccgaaggggaaggggctgggaggtggggtcggccgtattacgaaggaaagctaacagttacagtacagaatacggcgcgtctggtagaaaggagttcaccatctacaaagagatagaattacaaaagtacactaacttggtaaacttctagaacaaaatcgaaacacgacctaaacggaaaaacccggaggaacccgaacgggccgttaggttaattatttagggacggttaacgaaacgtaaaaggaggtaaggtaaagttgggttaggggtagggttaccgcgtttaggtacgg

SEQ ID NO: 361007 - DNA, 568 bp, Homo sapiens
  misc_feature: GZ8MTXP02HTWOB.21.4.A04.1.454.CMB.2.raw
  modified_base (202)..(202): a, c, t, g, unknown or other
  modified_base (212)..(212): a, c, t, g, unknown or other
  modified_base (270)..(270): a, c, t, g, unknown or other
tcagtcgtcgctcgcacgaccggtgctcgatttagagtagtgatcaggggaagagctgctcagttaggacccagagggaaccatggaaaccccagcgcagcttctcttcctcctgctactctggctcccaggctcagaaaccaccggagaaattgtgttgacgcagtctccaggcaccctgtcttttgtctccaggggaaanagccaccctntcctgcagctccagccagaaatatccagagctactacatagcctggtaccagcagaanctgcagctccacgtctcatctatgcgtcggtccgacgacggaccgactcgcactaccacgacacgtcgagtggcgaggtgggtcgtgggacgagacttactactctcatactattaagacagacgtagagacctagaagtaagtttacgtacagttagttatttacttagtacacgacgagtaagtaggtaagttactacctctcgttcgttcggtaccgaaacgggaaacgaaacggtaaacggtaaaagtaacgaaaacgaaacgtaacgtaggtacgtacgacgaccactactcg

SEQ ID NO: 361008 - DNA, 561 bp, Homo sapiens
  misc_feature: GZ8MTXP02HYU3O.21.4.A04.1.454.CMB.2.raw
  modified_base (215)..(215): a, c, t, g, unknown or other
  modified_base (528)..(528): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtctggggganacttggtccagcctgggagggtccctgagactctcctgtgcagcctctgcattcaccttcagtgaccacaacatggactggggtccgccaggctccgaggggaaggggctgggagtgggtcgccgtatacgaaggaaagctaacagttacagtaacagaatacggcgcgtctgtagaaaagggagttcaccatctacaaagagatgaatacaaaagaactacacttagtaatctgacaaatgaaacaggacctaagaaaacccgaggacaacggtccgtaggttaattattggtaggttaagaaacgaaaagngtaaggaattggtaggtaggtacgtcgtagtcg

SEQ ID NO: 361009 - DNA, 547 bp, Homo sapiens
  misc_feature: GZ8MTXP02FTED9.21.4.A04.1.454.CMB.2.raw
  modified_base (303)..(303): a, c, t, g, unknown or other
  modified_base (359)..(359): a, c, t, g, unknown or other
  modified_base (370)..(370): a, c, t, g, unknown or other
  modified_base (381)..(381): a, c, t, g, unknown or other
  modified_base (434)..(434): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggagggtccctgagactctcctgtgcagcctctgcattcaccttcagtgaccacaacatggactggggtccnccaggctccaggggagggctgggagtggggtcgcgtatacgaaggaaagctaaacngttacagtacngaaatacggcncgtctgtagaaaaggagttcaccatactcaaagagatgaattcaaaagactanaactgtatctagacaaaatgaaacagacctagaaaaccgaggacaacggccgtagtatttagtgtacggtaagaacaaaagagttggaatggtaggtaggtacgcgtaggtag

SEQ ID NO: 361010 - DNA, 519 bp, Homo sapiens
  misc_feature: GZ8MTXP02GTSQR.21.4.A04.1.454.CMB.2.raw
  modified_base (275)..(275): a, c, t, g, unknown or other
  modified_base (298)..(298): a, c, t, g, unknown or other
  modified_base (382)..(382): a, c, t, g, unknown or other
  modified_base (406)..(406): a, c, t, g, unknown or other
  modified_base (409)..(409): a, c, t, g, unknown or other
  modified_base (411)..(412): a, c, t, g, unknown or other
  modified_base (416)..(416): a, c, t, g, unknown or other
  modified_base (419)..(419): a, c, t, g, unknown or other
  modified_base (423)..(423): a, c, t, g, unknown or other
  modified_base (430)..(431): a, c, t, g, unknown or other
  modified_base (433)..(433): a, c, t, g, unknown or other
  modified_base (436)..(436): a, c, t, g, unknown or other
  modified_base (438)..(438): a, c, t, g, unknown or other
  modified_base (440)..(440): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtagtatttacaaggtgtcagtgtgaggtgcagctggtggagtctggggggagacttgggtccagcctggagggtccctgagactctcctgtgcagcctctgcattcaccttcagtnaccacaacatggactggggtccnccaggctccgaggggaaggggctgggagtgggtcggccgtattacaaggaagctaacagttacagtacagaatacggcgcgtcngtagaaagggagttcactatctanagnannatanaanacanatatatnnanaanananacacacgaacgagacgacgacgtagtattagtagtagtagaacgaaagagtaagtagtaggtaggtaggtagtcgtgtg

SEQ ID NO: 361011 - DNA, 544 bp, Homo sapiens
  misc_feature: GZ8MTXP02FIR2J.21.4.A04.1.454.CMB.2.raw
  modified_base (517)..(517): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggagggtccctgagactctcctgtgcagcctctgcattcaccttcagtgaccacaacatggactggggtcccgccaggctccaggggaaggggctggagtggggtcggccgtattacaaggaaagctaaacagttacagtacagaaatacgggcgcgtctggtgaaaagggaaggttcacccatctcaaagagatgattcaaaagaactcaactgtatctagacaaaatgaaacagacctagaaaaccgaggacacggccgtagtattatgtggtaagacaaaagngtaaggatggtggtggtagcgtgtacg

SEQ ID NO: 361012 - DNA, 605 bp, Homo sapiens
  misc_feature: GZ8MTXP02HNOO8.21.4.A04.1.454.CMB.2.raw
  modified_base (305)..(305): a, c, t, g, unknown or other
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagccctctgcattccaccttcagtgaccacaacatggactggggtccncaggctccgaggggaggctggagtgggtcgcgtatacgaaggaaagctaanagttacagtaacagaatacggcgtcgtctggtaagaaagggtaagttcaacccatctacaaagagatagtaattacaaaagaactacacttagtattctagaccaaaatcgaaacagtacccaaacggaaaaaccggaggaaccgaacgggtcccgtaggttaatttaagttaggtacgggttaagaaaaccgaaaaaggtaggtaagggtaagttaggtggggttacggttaaggccgtttaggtacg

SEQ ID NO: 361013 - DNA, 512 bp, Homo sapiens
  misc_feature: GZ8MTXP02JN3AG.21.4.A04.1.454.CMB.2.raw
  modified_base (201)..(201): a, c, t, g, unknown or other
  modified_base (291)..(291): a, c, t, g, unknown or other
  modified_base (397)..(397): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctctcctgcagctccagccagaatatccagacgctactacatagcctggtaccagcagaagcctggccaggctcccaggttcctnatctatgctggtcccagagggcccacgtggcactcccaagacaggttcagtcgcaggtgggtctggggacaggtacttcgactctacatcattacgcagactggancctagaagtattcgctagtgtattactgtcagcagtataggaattcactcgtgtcgttcgacaaggacaggtacgaaagtacgaaacgacgtgtacggctacgcacctatctacg

SEQ ID NO: 361014 - DNA, 532 bp, Homo sapiens
  misc_feature: GZ8MTXP02IWG15.21.4.A04.1.454.CMB.2.raw
  modified_base (202)..(202): a, c, t, g, unknown or other
  modified_base (292)..(292): a, c, t, g, unknown or other
  modified_base (298)..(298): a, c, t, g, unknown or other
  modified_base (351)..(351): a, c, t, g, unknown or other
  modified_base (369)..(369): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctccgaggttccnatctangctcggtcccagaggccagtggcactcccagactaggtcagtgcaggtggtcnggggacagacttcactcnatcatagcagactgacgtcctagaagtattcgctagttgtacttactgtcagtacagtataggtaagttcaccttgtgtcgttacggaccgtaaagggacctaaaggttaacgaaagtaacggaaaacgtaacgtggtaggactacgaccacctagtctttag

SEQ ID NO: 361015 - DNA, 578 bp, Homo sapiens
  misc_feature: GZ8MTXP02HEOIK.21.4.A04.1.454.CMB.2.raw
  modified_base (272)..(272): a, c, t, g, unknown or other
  modified_base (296)..(296): a, c, t, g, unknown or other
  modified_base (344)..(344): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgtagtatttacaaggtgtcagtgtgaggtgcagctggtggagtctgggggagacttggtccagcctggagggtccctgagactctcctgtgcagcctctgcattcaccttcagtnaccacaacatggactggggtcccncaggctccgaggggaagggctggagtgggtcgccgtatacaagggaanctaacagttacagtacagaatacggcgcgtctaggtagaaagggtaggttccaaccatctacaaagagacttgaatttacgaaaagaactactactagtatactacgtacaaataacgaacgaacgaccgtaacgaaaccgaacggaacgaacggtacggtacgttagttagttaggtaggtacgaacgaaagaaggtaaggtagtaggtaggtaggtacggtacgtacgtacg

SEQ ID NO: 361016 - DNA, 580 bp, Homo sapiens
  misc_feature: GZ8MTXP02FSYPV.21.4.A04.1.454.CMB.2.raw
  modified_base (305)..(305): a, c, t, g, unknown or other
  modified_base (350)..(350): a, c, t, g, unknown or other
  modified_base (355)..(355): a, c, t, g, unknown or other
  modified_base (416)..(416): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtcgaccacaacatggactggggtccnccaggctccgaggggagggctggagtgggcgcgtatacaaggaanctaanagttacagtaacagaatacggcgcgtctagtagaaaggtaagttcaaccatctacaaaganatgaattacgaaaagactacactgtaatctagacaaaatgaaacagacctaagaaaaacccgagggaacgaccgggtaccgtaggttaatttagttggtacggggttaagaaaacgtaaaagaggtaaggaagttaggtaggggttggtaacgcgttaggtacg

SEQ ID NO: 361017 - DNA, 687 bp, Homo sapiens
  misc_feature: GZ8MTXP02JRSXV.21.4.A04.1.454.CMB.2.raw
  modified_base (203)..(203): a, c, t, g, unknown or other
  modified_base (296)..(296): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatacgcctggtaccagcagaagcctggccaggcctcccgaggttcccncatctatcgcgtcgggtccccaacgacgggcccacgtggaccactccccaaggacctacgggttccaggtcggactaggtcggggtctgggggaactaggtacctttccgacttcgtacatcctaattacggactaacgtaccgtgggaacgtcccgttaaggaaacggttacgtttaccggacgttaaaggttaggtttaaactttaaccgttggttaccgaaggtaccgtaaaggttacgttaggggtaaacgtttcctaaccgtttcgttacggttccggtttaccggggaccgtaaacgggggtaaacccgtaaagggtaaacgaaaagttacggaaaaccggtaagtcggtacggacgtacggaccgtaacctagttccgtttacg

SEQ ID NO: 361018 - DNA, 579 bp, Homo sapiens
  misc_feature: GZ8MTXP02JZML0.21.4.A04.1.454.CMB.2.raw
  modified_base (200)..(200): a, c, t, g, unknown or other
  modified_base (290)..(290): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcccnatctatgctgggtccccacgacgggcccacgtggcactccccagacacggttcagtggcaggtgggtctggggacagacttcactctcatcattagcagactggagcctagaagtatttcgactagtgttattacgtgtacagtctaagttagtaggtaacgttcaccttcgtcggttaccggttccggggaccgtaaacgggggacccgtaaaaggggtaaacgtaaaagtacggaaaaccggtaacgtaacgggtacggtacgtcggacctacctagttacgtttcg

SEQ ID NO: 361019 - DNA, 566 bp, Homo sapiens
  misc_feature: GZ8MTXP02HWWL8.21.4.A04.1.454.CMB.2.raw
  modified_base (305)..(305): a, c, t, g, unknown or other
  modified_base (385)..(385): a, c, t, g, unknown or other
  modified_base (460)..(460): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctggagactctcctgtgcagcctctgcattcaccttcagtgaccacaacatggactgggtcccncaggctccgaggggagggctgggagtggggtcgccgtatacgaaggaaagctaaacagttacagtacagaaatacggcgngtctaggagaaagggagttcaccagtctacaagagatagaattacaaagaaactcaactgttaatctagacaaanaagaacaacgacgtaacgaaaccgaacgaacgacggtacgtagtagttagttagtaggtaacgaacgaaagaagtaagtagtaggtaggtaggtagtacgtagtcg

SEQ ID NO: 361020 - DNA, 537 bp, Homo sapiens
  misc_feature: GZ8MTXP02FWPMG.21.4.A04.1.454.CMB.2.raw
  modified_base (302)..(302): a, c, t, g, unknown or other
  modified_base (376)..(376): a, c, t, g, unknown or other
  modified_base (509)..(509): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggagggtccctgagactctcctgtgcagcctctgcattcaccttcagtgaccacaacatggactgggtccnccaggctccgaggggaggggctggagtgggtcgcgtatacaaggaagctaacagttacagtacagaatacggcncgtctgtgaaaggagttcaccatctcaaagagatgattacaaaagactcaactgtaactctagactaaatcgaaacagaccctaaggaaaacccgagacaacggcgtagtattatggtagtacgaaacaaagngtaagatggtaggtggtacgcgtagacg

SEQ ID NO: 361021 - DNA, 556 bp, Homo sapiens
  misc_feature: GZ8MTXP02G2GHD.21.4.A04.1.454.CMB.2.raw
  modified_base (486)..(486): a, c, t, g, unknown or other
  modified_base (529)..(529): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccgccaggctccgaggggaggggctgggagtgggtcggccgtattacgaaggaagctaacagttacagtacagaaatacggcgcgtctgtagaaaagggtaaggttcaacccatctacaaagagatagattacgaaaagaactcactagtatctgactaaagtcgaaacagaccctagaaaaccgnggaacacggaccgtagtattagtggtaggtacgaacgaaaagngtaaggatggtggtagtagctagtacg

SEQ ID NO: 361022 - DNA, 620 bp, Homo sapiens
  misc_feature: GZ8MTXP02FXWWK.21.4.A04.1.454.CMB.2.raw
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctattcaccttcagtgaccacaacatggactggggtcccnccaggctccgaggggaagggctggaggtgggtcgccgtatacgaaggaaagctaaacgagttacagtaacagaaatacgggcgcgtcgtaggtaggaaaagggtaagttccaaccgatcgtacaaagagatagtaattacaaaagtactacaacttgtaactctagaaccaaaatcggaaaacacggtaccctaaggaaaaacccgagggaaccaaccgggtaccgttaagttaatttacgttaggtaacgggtaaagaaaacgaaaaggaggttaaggaagttaggtaggggttaggtaaccgcgtaggtaacg

SEQ ID NO: 361023 - DNA, 549 bp, Homo sapiens
  misc_feature: GZ8MTXP02JSI3F.21.4.A04.1.454.CMB.2.raw
  modified_base (302)..(302): a, c, t, g, unknown or other
  modified_base (346)..(346): a, c, t, g, unknown or other
  modified_base (412)..(412): a, c, t, g, unknown or other
  modified_base (454)..(454): a, c, t, g, unknown or other
  modified_base (516)..(516): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactggggtccncaggctcgaggggagggctggagtgggtcgcgtatacaaggaanctaacagttacagtacagaatacgggcgcgtctggtagaaagggtagttcaaccgatctacaaagnatgattaccaaaagtactcacttgtatctgacaaatgaaacngacctaggaaaacccgagaccacggtccgtagtattagttggtacggtaagaactaaaaggngtaagggaattggtcgggtaggacgtcgtgtag

SEQ ID NO: 361024 - DNA, 578 bp, Homo sapiens
  misc_feature: GZ8MTXP02JJGKH.21.4.A04.1.454.CMB.2.raw
  modified_base (484)..(484): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccgccaggctccgaggggaggggctggagtgggtcggccgtatacgaaggaagctaacagttacagtacagaatacggcgcgtcgtagtagaaagggagttcaaccctatctacaagagatagaattacaaaagaactacacttgtatctagacaaaatgaaaccagacctaaggaaaacccgnggaaccgacgggtccgtagtaaagttagttaggtaggtaagaaacgaaaaggtagtaagggagttacgggtagggtaggtagtcgtaggtaacg

SEQ ID NO: 361025 - DNA, 598 bp, Homo sapiens
  misc_feature: GZ8MTXP02F9TS1.21.4.A04.1.454.CMB.2.raw
  modified_base (305)..(305): a, c, t, g, unknown or other
  modified_base (356)..(356): a, c, t, g, unknown or other
  modified_base (362)..(362): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattccaccttcagtcgaccacaacatggactggggtccnccgaggctccgaggggaagggctggaggtgggtcgcgtatacgaaggaaanctaaanagttacagtaacagaaatacggcgcgtcgtaggagaaaagggtaaggttacaacccatctacaaagagatagattacaaaagaactacaactagtaatcgtagaacaaaatacgaaacacgaacctaaggaaaaccgagggaacaccgggtacgtagtaatttagttaggtaagggtaacgaaacgaaaaaggtaggtaagggtaatgggtagggtacggtagacgttaggtaacg

SEQ ID NO: 361026 - DNA, 559 bp, Homo sapiens
  misc_feature: GZ8MTXP02HOVPK.21.4.A04.1.454.CMB.2.raw
  modified_base (201)..(201): a, c, t, g, unknown or other
  modified_base (290)..(290): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttccncatctatgctgggtcccacgacgggccacgtggcactcccagacacggttcagtggcaggtgggtctggggactaggacttcgactctcatcattagcagacgtggacgcctaggaacgtcgtttacgacgtagttgttatttacgttgtactagactagtagtggtaattcgacttcgtgtcgttcggacgtaagggaccgaaaggttaacgaaacgtacgaaaacgtacgtaacggtacggacgtacggactaccgtagttacttcg

SEQ ID NO: 361027 - DNA, 556 bp, Homo sapiens
  misc_feature: GZ8MTXP02JR94S.21.4.A04.1.454.CMB.2.raw
  modified_base (311)..(311): a, c, t, g, unknown or other
  modified_base (385)..(385): a, c, t, g, unknown or other
  modified_base (416)..(416): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctgggtggagtcgtggggggagacttgggtccaggccctgggaggggtccctgagactctcctgtgcagcctctgcattcaccttcagtcgaccacaacatggactggggtccncaggctccgaggggagggctggagtgggtcgccgtatacgaaggaagctaaacagttacagtacagaatacggnacgtctggtagaaagggagttcaccatctanaaagagatgaattacaaaagaactacactagtatactagacaaatagaacacgacgaacgaaacgaacgaacgacgacgtagtattagtagtagtagaacgaaagaagtaaggtagtaggtaggtaggtagtacgtagtg

SEQ ID NO: 361028 - DNA, 558 bp, Homo sapiens
  misc_feature: GZ8MTXP02JLUKH.21.4.A04.1.454.CMB.2.raw
  modified_base (277)..(277): a, c, t, g, unknown or other
  modified_base (299)..(299): a, c, t, g, unknown or other
  modified_base (376)..(376): a, c, t, g, unknown or other
  modified_base (408)..(408): a, c, t, g, unknown or other
  modified_base (485)..(485): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttctgttagttatttacaaggtgtcagtgtgaggtgcagctggtggagtcgtgggggagacttggtccagcctgggagggtccctgagactctcctgtgcagcctctgcattcaccttcagtnaccacaacatggactgggtccncaggctcgagggagggctggagtgggtcgcgtatacgaaggaagctaacagttacagtacagaactacggcgccgtntggtagaaaagggtagttccaacctatcctanaaagagatgtaattacaaaagtaccttacacttagtatctagaacaaaatcgaaacacggaccctaagaaaacccgngggaacacgggtctagttatagtgtggaaacaacaaaaggngtaaggatgggtaggtacgtagtcgtaggacg

SEQ ID NO: 361029 - DNA, 552 bp, Homo sapiens
  misc_feature: GZ8MTXP02FTVVZ.21.4.A04.1.454.CMB.2.raw
  modified_base (357)..(357): a, c, t, g, unknown or other
  modified_base (363)..(363): a, c, t, g, unknown or other
  modified_base (418)..(418): a, c, t, g, unknown or other
  modified_base (516)..(516): a, c, t, g, unknown or other
  modified_base (525)..(525): a, c, t, g, unknown or other
  modified_base (527)..(527): a, c, t, g, unknown or other
  modified_base (544)..(544): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgctattcaccttcagtgaccacaacatggactcggggtccgccgaggcctccgaggggaagggctgggagtgggtcgcgtatacgaaggaanctaaanagttacagtacagaatacgggcgcgtctgtaggaaagggagttcaacctatctanaagagatgaattacaaaagtactcactgtactctagactaaatacgaacaggaccctaaggaaaacccgaggacacggccgtagtattagtgaggtanaacgaaagngnggattcggtaggtgtanctagtacg

SEQ ID NO: 361030 - DNA, 569 bp, Homo sapiens
  misc_feature: GZ8MTXP02GD0MG.21.4.A04.1.454.CMB.2.raw
  modified_base (492)..(492): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggaatttgggctgagctgggttttccttgttgttattttacaaggtgtccagtgtgaggtgcagctggtggagtcgtgggggagacttgggtccagcctgggagggtccctgagactctcctgtgcagcctctgcattcaccttcagtgaccacaacatggactggggtcccgccaggctccgaggggaaggggctggagtggggtcgcgtatacaaggaaagctaaacagttacagtacagaaatacgggcgacgtctaggtagaaaagggaagttcaaccgatctacaaagagatgaattacaaaagactacactgtaactcgtagacaaaatcgaaacagacctaagaaaaacccgnggaaccacggaccgtagttaattagttaggtaggtaagaacaaaaggagtaaggatggtgggtagtacgcgtgtacg

SEQ ID NO: 361031 - DNA, 543 bp, Homo sapiens
  misc_feature: GZ8MTXP02JVYIT.21.4.A04.1.454.CMB.2.raw
  modified_base (200)..(200): a, c, t, g, unknown or other
  modified_base (290)..(290): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccagggaaangccacctctcctgcagctccagccagaatatccagagctactacatacgcctggtaccagcagaagcctggccaggctcccgaggttccnatctatgctcgggtcccacgacgggcccactcggcactccccagaccaggttcagtggcaggtgggctggggacaggacttcgactctcactcattagcagactggagcctagaacgtattcgacgtagtgttattacgtgtcagtctagtagtggtaacttcacttcgtcgtcgttcgaccgagggtaccgaaggtaacgtaagtacgaaacgtaacgtggtcggacgtacggacctaccgtagtacgttcg

SEQ ID NO: 361032 - DNA, 584 bp, Homo sapiens
  misc_feature: GZ8MTXP02GFW2A.21.4.A04.1.454.CMB.2.raw
  modified_base (282)..(282): a, c, t, g, unknown or other
  modified_base (490)..(490): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttgggtccagcctgggagggtccctgagactctcctgtgcagcctctgcattcaccttcagtnaccacaacatggactggggtcccgccaggctccgaggggagggctggagtgggtcgcgtatacgaaggaagctaacagttacagtacagaatacgggcgcgtctggtacgaaaagggtaggttccaaccatctacgaaagagatggaattcaaaagtaactcacttgtatctagacaaaatgaaacagtccctaaggaaaaacccggnggaccacggtcgttagttattacgttggtaggtaaacgaaacgaaaaggtaggtaacggtaagttgggttacgggtaggtacgcgttaggtacg

SEQ ID NO: 361033 - DNA, 566 bp, Homo sapiens
  misc_feature: GZ8MTXP02JKL2P.21.4.A04.1.454.CMB.2.raw
  modified_base (300)..(300): a, c, t, g, unknown or other
  modified_base (386)..(386): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgtgttatttacaaggtgtcagtgtgaggtgcagctgggtggagtcgtgggggagacttggtccagcctgggagggtccctgagactctcctgtgcagcctctgcattcaccttcagtcgaccacaacatggactggggtcccnccaggcctccgaggggaagggctggagtgggcggctatacgaaggaaagctaacagttacaagtacagaaactacgggcgaccgtntaggtaggaaaagggacgttccaaaccctatcctagaagagatagattacaaagaaactacactagtatactgaacaataagaacacgacgaacgaaacgaacgacgacgtacgtagtattagttagtaggtaacgaacgaaagaagtaaggtagtaggtaggtaggtagtacgtagtag

SEQ ID NO: 361034 - DNA, 626 bp, Homo sapiens
  misc_feature: GZ8MTXP02JRMSY.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccccgagacgtctcctcgtgcacgcgtcctgcgacttctacctcctagtgaccaaccaacaataggacgtacgggtcccggtcccgacggcgtcccgacggggaagggggacggtcgggaggtggggtcggggtccggtacgttaacgtaaggaaaacggactaaccgtaagtaactacggtaacgaagagtaacggtacggcgttaccgtgtaggaaaggtaaagggttcaccaacgtctacaaggaagatgattacaaagaacgtctactgttatctagacaaataagacaagccgtaagaaaccgaaggcgacgccggtagtattagttcgtagggtaacgaacaaaagtagtggaagtgtaggggtgtaggtactggtacgtac

SEQ ID NO: 361035 - DNA, 542 bp, Homo sapiens
  misc_feature: GZ8MTXP02HFP9K.21.4.A04.1.454.CMB.2.raw
  modified_base (305)..(305): a, c, t, g, unknown or other
  modified_base (364)..(364): a, c, t, g, unknown or other
  modified_base (443)..(443): a, c, t, g, unknown or other
  modified_base (480)..(480): a, c, t, g, unknown or other
  modified_base (506)..(506): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggaggggtccctgagactctcctgtgcagcctctgcattcaccttcagtgacccacaacatggactggggtccnccaggctccgaggggaaggggctggagtgggtcggccgtagttacaaggaaagctaaanagttacagtacagaaatacggcgcgtctgtagaaaagggagttcaaccatctacaaagagatgattacaaaagaactanaacttgtatctgacaaatgaacagacctagaaaacgngacacggtcctgtattatgtaggtanactaaaagagtggaatggtaggtgtacgcgtgtacg

SEQ ID NO: 361036 - DNA, 499 bp, Homo sapiens
  misc_feature: GZ8MTXP02JCDMO.21.4.A04.1.454.CMB.2.raw
  modified_base (201)..(201): a, c, t, g, unknown or other
  modified_base (291)..(291): a, c, t, g, unknown or other
  modified_base (435)..(435): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggaaangccaccctctcctgcagctccagccagaatatccagagctactacatagcctggtaccagcagaagcctggccaggctcccaggttcctnatctatgctcggtcccagacgggccactggcatcccagacaggttcagtgcagtggctggggacaggacttcatctcatcattagcagactggagctagaagtattcgctagtgtattactgtacagcagtatgaagttcactntgtcgttcgccgaaggacaaaggtagaaagtacgaaacgaacgtgtagctacgacaccatcgtg

SEQ ID NO: 361037 - DNA, 510 bp, Homo sapiens
  misc_feature: GZ8MTXP02JNFYJ.21.4.A04.1.454.CMB.2.raw
  modified_base (203)..(203): a, c, t, g, unknown or other
  modified_base (293)..(293): a, c, t, g, unknown or other
  modified_base (448)..(448): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaagcctggccaggctcccaggttcctnatctatgctcgggtcccagagggcccagtggcactcccagactacggttcaggtgctaggtgggtctggggacagtacttcactctcatcattagcagacgtgagcctagaagtattcgctagtgtattactgtacagcagtagtggattcactntgtcgtcgacgaggacaaggtagaaactagaaacgacgtgacgacgtacgactaccagtctg

SEQ ID NO: 361038 - DNA, 558 bp, Homo sapiens
  misc_feature: GZ8MTXP02JD2DM.21.4.A04.1.454.CMB.2.raw
  modified_base (200)..(200): a, c, t, g, unknown or other
  modified_base (291)..(291): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtcttgtctccaggggaangccaccctctcctgcagctccagccagaatatccagagctactacatagcctggtaccagcagaagcctggccaggcctcccaggttcccnatctatcgctgggtccccagacgggcccacgtggccatccccagacacggttcaggtgctaggtcggggtctgggggacaggtacttcgactctacatcattagcagacgtggacgccgtagaagtattcgactagtgtattactgtcagtcagtagtggtaacgttcaccgttcgtcgtccggttacggaccgtaacgggaaccgtaaaggtaacgaaagtacggaaaacgtaacgtggtacggactacggacactactcgttacg

SEQ ID NO: 361039 - DNA, 629 bp, Homo sapiens
  misc_feature: GZ8MTXP02JUTFM.21.4.A04.1.454.CMB.2.raw
  modified_base (203)..(203): a, c, t, g, unknown or other
  modified_base (296)..(296): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatacgcctggtaccagcagaacgcctggccaggcctcccaggttccnatctatgctcgggtccccagacggcccacgtggcatcccagactacggttcaggtgctagggtcgggtctggggacaggtaccttcgacttctactactctaattacgcgagtacgtggacgtccgtagaaagtatttacgacgtaggttgttaattacgtgtacgtagactaagttagtaggttaacgttccgtaccgttcgtacggttcggttaccgggaaccggtaaacggggtaacccgtaaaaggggtaaacgtaaaacgtaacggtaaaaccgtaacggttaacgggtacgggtacgtacggacctaacccgtagttccgtttaccg

SEQ ID NO: 361040 - DNA, 515 bp, Homo sapiens
  misc_feature: GZ8MTXP02IOKCT.21.4.A04.1.454.CMB.2.raw
  modified_base (200)..(200): a, c, t, g, unknown or other
  modified_base (291)..(291): a, c, t, g, unknown or other
  modified_base (378)..(378): a, c, t, g, unknown or other
  modified_base (397)..(397): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctgactcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttccnatctatgctcggcccagaggcccagtggccatccccagactaggttcagtcggactaggtcgggtctgggggacagtacttcactcnatctatagcagactggacncctagaagtattcgctagttgttattacgtgtacagactagtataggtaagtcactcgtgtcgttcgacaagggacaaggtagaactacgaaacgagtgtggctcgacactatctacg

SEQ ID NO: 361041 - DNA, 608 bp, Homo sapiens
  misc_feature: GZ8MTXP02F4E9Y.21.4.A04.1.454.CMB.2.raw
  modified_base (201)..(201): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtcttgtctccaggggaaanagccaccctctcctgcagctccagccagaatatccagagctactacatagcctggtaccagcagaagcctggcccaggcctccccgaggttcctcatcctatcggctcgggtccccacgacgggcccacgtgggacactccccaaggaccacgggtttccaggtggcgtaggttcggggtctgggggacacggtacttcactctcatcattagcagacgtggacgccgtagaagtacttcgctagttgttattacgtgtacagtctagtagtaggtaacgttcaccgttcgtggttaccgttaccgggaccgtaaacggggtaaccgtaaagggtaacgtaaaagtaacggaaaacggtaaccgtaaggtacggtacttacggacctaaccgtaagttacgtttcgg

SEQ ID NO: 361042 - DNA, 574 bp, Homo sapiens
  misc_feature: GZ8MTXP02JN02Z.21.4.A04.1.454.CMB.2.raw
  modified_base (301)..(301): a, c, t, g, unknown or other
  modified_base (348)..(348): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctggtggagtctgggggagacttggtccagcctgggagggtccctgagactctcctgtgcagcctctgcattcaccttcagtgaccacaacatggactgggtccnccaggctccgaggggagggctgggagtgggtcgcgtatacaaggaanctaacagttacagtacagaatacggcgcgtctgtagaaaggtagttcaaccgatctacaaagagatagaattacaaaagaccttacacttagtaactctagactaaaatgaaacaggcctaagaaaaccgaggaaccacgggtactaggttaattacgttaggtacggtaagaaactaaaaggtggtaaggaattcgggtagggtaggttaccggtcgtaggtacg

SEQ ID NO: 361043 - DNA, 528 bp, Homo sapiens
  misc_feature: GZ8MTXP02FPG30.21.4.A04.1.454.CMB.2.raw
  modified_base (265)..(265): a, c, t, g, unknown or other
  modified_base (288)..(288): a, c, t, g, unknown or other
  modified_base (292)..(292): a, c, t, g, unknown or other
  modified_base (306)..(306): a, c, t, g, unknown or other
  modified_base (352)..(352): a, c, t, g, unknown or other
  modified_base (357)..(357): a, c, t, g, unknown or other
  modified_base (377)..(377): a, c, t, g, unknown or other
  modified_base (381)..(381): a, c, t, g, unknown or other
  modified_base (404)..(404): a, c, t, g, unknown or other
  modified_base (409)..(409): a, c, t, g, unknown or other
  modified_base (445)..(445): a, c, t, g, unknown or other
tcagtcgtcgctcgcacgaccggtgctcgatttagagtagtgatcatgggagctctgagagcggagccccagccccagaattcccaggtgttttcatttggtgatcagcactgaacacagaggactcaccatggagttgggctgagctgggttttccttgttgttattttacaaggtgtccagtgtgaggtgcagcgtggtggagtcgtgggggatacttggtccagccgtgggacgggtccctgagtactctctgtgcagcctntgcattcaccttcagtcgaccanaacngtggactgggtccncgaggctcgaggggagggctggagtgggcgcgtatacgaaggtaanctaanagtacagtcagaatacggcncgtntgtagaaaggagttcacatctanaaagngatgattacaaagaactcatgtatctagactaaaangaacacgacaagaaacgagacgacggtactagtattagtagtagaacaagaaagtgtaggtagtggtaggtacggtagtcgtg

SEQ ID NO: 361044 - DNA, 519 bp, Homo sapiens
  misc_feature: GZ8MTXP02J0WKU.21.4.A04.1.454.CMB.2.raw
  modified_base (202)..(202): a, c, t, g, unknown or other
  modified_base (291)..(291): a, c, t, g, unknown or other
  modified_base (309)..(309): a, c, t, g, unknown or other
  modified_base (439)..(439): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccnatctatgctgggtcccanagggccactggcatcccagacaggttcagtgcagtgggtctggggacagacttcactctcatcattagcagactgagcctagaagtatttcgctagtgtattactgtcagcagtataggaagttcacctntcgttcgttcggccaaagggaccgtaaaggtacgaaaagtacgaaaacgtaacgtggtacggctcgacaccgattccgtg

SEQ ID NO: 361045 - DNA, 502 bp, Homo sapiens
  misc_feature: GZ8MTXP02GMUYU.21.4.A04.1.454.CMB.2.raw
  modified_base (200)..(200): a, c, t, g, unknown or other
  modified_base (288)..(288): a, c, t, g, unknown or other
  modified_base (306)..(306): a, c, t, g, unknown or other
tcagtcgtcgctcgcacgaccggtgctcgatttagagtagtgatcaggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaagcctggccaggctccaggtcctnatctatgctggtcccagngggcccactggcatcccagacaggttcagtggcagtggtctggggacaggacttcactctcatcattagcagactggagcctgaagtattcgctagtgtattactgtcagcagtatggaagttcaccttcgtgtcgttcggccgaaagggaccaaaggtagaaacgtacgaaacgaactgtgactgacacatctcg

SEQ ID NO: 361046 - DNA, 581 bp, Homo sapiens
  misc_feature: GZ8MTXP02F0UGQ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtccgccaggctccgaggggagggctggagtgggtcgcgtatacgaagaagctaacagttacagtacagaatacggcgcgtctggtaggaaaaggaaggttcaaacccgatacctacgaaagagatgaattacaaaagactacgactgtatctagacaaaatgaaacagaccctaaggaaaacccgaggaacacgggaccggttagtaaatttagttaggtagggtaagaaacgaaaaaggtaggtaaggaagttggtacggggtaggtaagcgttaggtaacg

SEQ ID NO: 361047 - DNA, 575 bp, Homo sapiens
  misc_feature: GZ8MTXP02G2YFL.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtgaccacaacatggactggggtcccgccaggcctccgaggggaaggggctgggaggtggggtcggccgtagtacgaaggaagctaacagttacagtacagaatacggcgcgtctggtagaaagggaagttcaaccgtatactacgaaagtagatagaattacgaaaagtaactcgaactgtatcgtagacaaatgaaacagccctaaagaaaaccgaggaccgacgggtctagttaattattggtaggtaagaactaaaaggaggtggaatggtacgggtaggtacgcgttagtacg

SEQ ID NO: 361048 - DNA, 610 bp, Homo sapiens
  misc_feature: GZ8MTXP02FM2Y8.21.4.A04.1.454.CMB.2.raw
  modified_base (304)..(304): a, c, t, g, unknown or other
  modified_base (351)..(351): a, c, t, g, unknown or other
  modified_base (383)..(383): a, c, t, g, unknown or other
  modified_base (564)..(564): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtcgaccacaacatggactgggtccnccaggctccgaggggagggctggagtgggtcgcgtatacgaaggaanctaacagttacagtacagaatacgggcgcgtntggtagaaaagggtacgttcaacccgtatctacgaaagtagatagaattaccaaaaagaccttacacttagtaatcgtagaacaaaatcgaaacagacccgtaaaggaaaaaccccggaggaaccgaaccgggtaccgttagttaaatttagtaggtagggtaaacgaaaactaaaagggngtaagggaagttgggttacggggtaggttaacgcttagggtaaccg

SEQ ID NO: 361049 - DNA, 541 bp, Homo sapiens
  misc_feature: GZ8MTXP02JGK7I.21.4.A04.1.454.CMB.2.raw
  modified_base (303)..(303): a, c, t, g, unknown or other
  modified_base (347)..(347): a, c, t, g, unknown or other
  modified_base (378)..(378): a, c, t, g, unknown or other
  modified_base (408)..(408): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacatggactgggtccncaggcctcgaggggagggctggagtgggcgcgtatacaaggaanctaacagttacagtacagaatacggcgcgtntgtagaaagggagttcaaccatcacaaganatagattacaaaagtactacacttgtatctagacaaatcgaacagacctaaggaaaccgaggacacggtcgtagtattacgtggtacggagaaacgaaaggtgtaaggagtggtcggtaggtagcgtagtacg

SEQ ID NO: 361050 - DNA, 641 bp, Homo sapiens
  misc_feature: GZ8MTXP02JHNDY.21.4.A04.1.454.CMB.2.raw
  modified_base (544)..(544): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctggtgcagcctctgcattccaccttcagtcgaccacaacatggactggggtcccgccaggcctccgaggggagggctggagtgggtcggctagtacgaaggaagctaacagttacagtacagaaatacgggcgtcgtcgtggtacgaaaagggtacggttcaacccgtatccgtacaaaaggagagttagaaatttaccgaaaaagtaaccttacgaacttaggttaacttccgttaggaaccaaaaagtacggaaaaccaaggtacccccgtaaaggaaaaaaccccggngggaaaccaaccgggtccgtagtttaagttacgttggtacggtaaagaaacgaaaaagtggtaaggtaagttggtacggggtagtagccgtgtaacg

SEQ ID NO: 361051 - DNA, 548 bp, Homo sapiens
  misc_feature: GZ8MTXP02JN6BF.21.4.A04.1.454.CMB.2.raw
  modified_base (518)..(518): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtcccgccaggctccgaggggaaggggctgggagtggggtcggccgtattacgaaggaagctaacagttacagtacagaatacggcgcgtctggtagaaagggaaggttcaaccatctcaagagatgaattacaaagaactcactgtatctgacaaatgaaacagacctagaaaacccgaggaaccacgggccgtagtattatggtaggtagaacgaaaagngtggaagttggtaggtggtacgcgtgtacg

SEQ ID NO: 361052 - DNA, 576 bp, Homo sapiens
  misc_feature: GZ8MTXP02IWZR6.21.4.A04.1.454.CMB.2.raw
  modified_base (305)..(305): a, c, t, g, unknown or other
  modified_base (362)..(362): a, c, t, g, unknown or other
  modified_base (538)..(538): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacgttggtccagcctgggagggtccctgagactctcctgtgcagcctctgcattcaccttcagtgaccacaacatggactggggtccnccaggcctccgaggggaagggctgggagtgggtcgccgtatacgaaggaaagctaanagtacagtacagaatacggcgcgtctagagaaaggagttcaccatctacaagagatagattacaaaagactcactgtaatctagacaaaatagaacagtaccctaaggaaaacccggaggaaaccaccgggtacttaggttaatttacgttaggtacggtaagaaaactaaaaggnggtaaggagttaggtagggtacggtagtcgtaggtacg

SEQ ID NO: 361053 - DNA, 580 bp, Homo sapiens
  misc_feature: GZ8MTXP02FWIVT.21.4.A04.1.454.CMB.2.raw
  modified_base (262)..(262): a, c, t, g, unknown or other
  modified_base (301)..(301): a, c, t, g, unknown or other
  modified_base (346)..(346): a, c, t, g, unknown or other
  modified_base (352)..(352): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctntgcattcaccttcagtgaccacaacatggactgggtccncaggctccgaggggagggctggagtgggtcgcgtatacaaggaanctaaangttacagtacagaatacggcgcgtctagaggaaaagggaaggttccaaccatcctacgaaagagatagaattacgaaaaagtactacaacgttgtactctaggacaaaagtcgaaacagaccctaaaggaaaacccgagggaccaacgggtaccgttagtattaacgttggtaggtaagaaacaaaaggagtaagggtaatgggtacgggtgtaacgcgttaggtacg

SEQ ID NO: 361054 - DNA, 575 bp, Homo sapiens
  misc_feature: GZ8MTXP02GQ1RS.21.4.A04.1.454.CMB.2.raw
  modified_base (305)..(305): a, c, t, g, unknown or other
  modified_base (353)..(353): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagctgggttttccttgttgttattttacaaggtgtccagtgtgaggtgcagctggtggagtcgtgggggagacttggtccaggcctgggagggtccctgagactctcctgtgcagcctctgcattccaccttcagtcgaccacaacatggactgggtccncaggctccgagggagggctgggagtgggtcgccgtatacgaaggaacnctaacagttacagtacagagtacggcgcgtctagtagaaaggtagttcacatctacgaaagagatagaattacgaaaagtactctaactagtatctagaactaaaagtagaaacagaccgtaaggaaaacccgaggaaccacgggtaccgttagtagtttagttcggtaggtaaagaacgaaaagtggtaggaagttggtcggtaggtagcgtgtacgaacg

SEQ ID NO: 361055 - DNA, 534 bp, Homo sapiens
  misc_feature: GZ8MTXP02I06Z3.21.4.A04.1.454.CMB.2.raw
  modified_base (203)..(203): a, c, t, g, unknown or other
  modified_base (298)..(298): a, c, t, g, unknown or other
  modified_base (317)..(317): a, c, t, g, unknown or other
  modified_base (360)..(360): a, c, t, g, unknown or other
  modified_base (406)..(406): a, c, t, g, unknown or other
  modified_base (427)..(427): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccaagaatatccagagctactacatagcctggtaccagcagaacgcctgggccaggcctcccgaggttcctnatctatgctgggtcccagngggcccagtggcactcccagacaggttcagtgcaggtggttcnggggacagacttcactctcatcatagcagactggagcctagaagtnttcgctagtgtattactgtanagctaagtacgtaggaagttcacctgtgtcgttcggacgtaagggaccgaaaggtaagaaactacggaaaacgaacgtggtaggacgtacgaccacctagtcttacg

SEQ ID NO: 361056 - DNA, 610 bp, Homo sapiens
  misc_feature: GZ8MTXP02GVQEK.21.4.A04.1.454.CMB.2.raw
  modified_base (263)..(263): a, c, t, g, unknown or other
  modified_base (378)..(378): a, c, t, g, unknown or other
  modified_base (412)..(412): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctntgcattcaccttcagtcgaccacaacagtggactgggtccgccaggctcgaggggagggctggagtgggtcgccgtatacgaaggaagctaacagttacagtacagaatacggcncgtctaggtagaaaggtacgttcaaccgtatcanaagagatagtaattacgaaaagtaactacacttagtactcgtagaactaaaagtcgaaaaccgagacccgtaaaggaaaaacccggaggaaaccgaccggggtacccgttaggttaaatttaggtttagggtaacggttaaagaaacgaaaaagtgggtaagggtatcgggttagggtaggtacgtcgtaggttaccg

SEQ ID NO: 361057 - DNA, 613 bp, Homo sapiens
  misc_feature: GZ8MTXP02G2K8G.21.4.A04.1.454.CMB.2.raw
  modified_base (202)..(202): a, c, t, g, unknown or other
  modified_base (234)..(234): a, c, t, g, unknown or other
  modified_base (248)..(248): a, c, t, g, unknown or other
  modified_base (292)..(292): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccagaatntccagagctactanatagcctggaccagcagagcctggccaggcctcccaggttcccnatctatcgcgtcggtcccagagggcccagtggccaactccccgaaggtactagggttcaggttcggactagggttcggggtctgggggactaggtaccttcacgttctacatacattagcagactggacgtccgtagtaacgtatttcgacgtagttgttagttcttgacgagtacaggttataggtacgttaccaccgttgtacggttccggtttaccggaccgtaaaggggtaccctaaaagggggttaacaaaacgtaacgggtaaaacgtaacgttgggtaacggtaccttacggacctaaccttacgttactttcg

SEQ ID NO: 361058 - DNA, 583 bp, Homo sapiens
  misc_feature: GZ8MTXP02I1ZOF.21.4.A04.1.454.CMB.2.raw
  modified_base (348)..(348): a, c, t, g, unknown or other
  modified_base (417)..(417): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactgggtccgcaggcctccgaggggagggctggagtgggcgccgtatacaaggaanctaacagttacagtacagaactacggcgcgtctggagaaaaggtagttccaaccgatactacgaaaganatgtaattacgaaaagtactcacttgtatctagacaaaatcgaaacacgacctaaaggaaaacccggagaaccgaccgggtacgtagttaattagttggtaaggttaacgaaaacgtaaaaggaggttaaggacgttagggtagggtaccggtagcgttaggtacg

SEQ ID NO: 361059 - DNA, 553 bp, Homo sapiens
  misc_feature: GZ8MTXP02GJTQ0.21.4.A04.1.454.CMB.2.raw
  modified_base (305)..(305): a, c, t, g, unknown or other
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggaatttgggctgagctgggttttccttgttgttattttacaaggtgtccagtgtgaggtgcagctggtggagtcgtgggggagacttgggtccagcctgggagggtccctgagactctcctgtgcagcctctgcattcaccttcagtgaccacaacatggactggggtcccnccaggctccgaggggaagggctggaggtgggtcgccgtatacgaaggaaanctaaacagttacagtaacagaatacggcgcgtctagtagaaaaggaaggttacaaccatactacaaagagatagaattacaaaagactacactagtatctgacaaaatagaacagacctaagaaaaccgaggacacggactagtattatggtagtagaacaaaagagtaaggaatggtaggtggtacgcgtagtacg

SEQ ID NO: 361060 - DNA, 545 bp, Homo sapiens
  misc_feature: GZ8MTXP02HN9NA.21.4.A04.1.454.CMB.2.raw
  modified_base (518)..(518): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctggagggtccctgagactctcctgtgcagcctctgcattcaccttcagtgaccacaacatggactggggtccgccaggctccgaggggaagggctgggagtgggcgccgtatacgaaggaagctaacagttacagtacagaatacggcgcgtctgtagaaaggaagttcaccatctacaagagatgattacaaaagactacactgtaattctagacaaatcgaaacagaccctaggaaaacccgaggaacacgggaccgtagtaattattggtaggtaagactaaaagnggtaagatggtggtaggtagctgtacg

SEQ ID NO: 361061 - DNA, 558 bp, Homo sapiens
  misc_feature: GZ8MTXP02I2T28.21.4.A04.1.454.CMB.2.raw
  modified_base (302)..(302): a, c, t, g, unknown or other
  modified_base (483)..(483): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccnccaggctccgaggggaagggctgggagtgggtcgccgtatacgaaggaaagctaacagttacagtaacagatacggcgcgtctgtaggaaaagggacggttacacatcacaaagagaatgaattacaaaagaaactcaactgtatctagacaaaagtgaaaccagacctacgaaaaaccgnggaacgacggccgtagtattattgtaggtaagtaacaaaaagtgaggaatggtaggtaggtacgcgtagtacacg

SEQ ID NO: 361062 - DNA, 634 bp, Homo sapiens
  misc_feature: GZ8MTXP02GMMYI.21.4.A04.1.454.CMB.2.raw
  modified_base (197)..(197): a, c, t, g, unknown or other
  modified_base (287)..(287): a, c, t, g, unknown or other
  modified_base (305)..(305): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctccaggctcaagaaaccacggagaaattgtgttgacgcagtctccaggcacctgtctttgctccaggggaaangccacctctcctgcagctccagccaagaatatccagagctactacatacgcctggtaccagcagaagcctggccaggctcccaggttccncatctatgctggtcccanaggccatggcatcccagacaggttcagtgacaggtcggttcgacggggacaacgtaccttacaccttcactaatactaagttacgactaacgtacgttagggaaccgtcgtaagtaacgttacgttacgagttacggttagttaacgttacgtacgtacgagtacgtaaggttacgtacggttaacttacctaccgttcgttacggttaccggttaccggaaaccgggtaaaacgggtaaacggtaaaagggttaaacgtaaacgtaaaacggtaaaccgtaacggtaaggtacggtacgtacgaacctaaccgtacgttacgtttacg

SEQ ID NO: 361063 - DNA, 537 bp, Homo sapiens
  misc_feature: GZ8MTXP02JDAF8.21.4.A04.1.454.CMB.2.raw
  modified_base (302)..(302): a, c, t, g, unknown or other
  modified_base (479)..(479): a, c, t, g, unknown or other
  modified_base (513)..(513): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactggggtccnccaggctccgaggggagggctggagtgggtcgcgtatacgaaggaagctaacagttacagtacagaatacggcgcgtctgtagaaaggtagttcaccatctacaaagagatagaattacaaaaagtacctacacttgtaactcgtagactaaaatgaaacagacctaagaaaaccgngacacggctagtattagtgagtacgaacgaaagngtggatgtaggtcgtagctgtacg

SEQ ID NO: 361064 - DNA, 556 bp, Homo sapiens
  misc_feature: GZ8MTXP02G8ARE.21.4.A04.1.454.CMB.2.raw
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccgccaggctccgaggggaggggctggagtggggtcgccgtattacaaggaagctaanagttacagtacagaatacggcgcgtctgtagaaaagggaaggttcaacccgatctacaaagagatagaattacaaaagactacactagtatctagacaaaatgaaacagacctagaaaaccgaggacacggaccgtgtattagttggtaggtaagaaacaaaaggtagtaaggaatggtaggtaggtacgtcgtggtacg

SEQ ID NO: 361065 - DNA, 526 bp, Homo sapiens
  misc_feature: GZ8MTXP02HK7G4.21.4.A04.1.454.CMB.2.raw
  modified_base (301)..(301): a, c, t, g, unknown or other
  modified_base (350)..(350): a, c, t, g, unknown or other
  modified_base (463)..(463): a, c, t, g, unknown or other
  modified_base (500)..(500): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactgggtccncaggctccgagggagggctggagtgggcgcgtatacaaggaagctaacngttacagtacagaatacggcgcgtctggtagaaagggaagttcaaccatctacaaagagatagattacaaaagactcactgtatctgacaaatgaacagacctagaaaaccgngacacggcgtagtattagtgtaggtaagacgaaaagngtaaggataggtggtgtagctgtacg

SEQ ID NO: 361066 - DNA, 573 bp, Homo sapiens
  misc_feature: GZ8MTXP02HX87S.21.4.A04.1.454.CMB.2.raw
  modified_base (266)..(266): a, c, t, g, unknown or other
  modified_base (309)..(309): a, c, t, g, unknown or other
  modified_base (355)..(355): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggtccctgagactctcctgtgcagcctntgcattccaccttcagtcgaccacaacatggactggggtcccncaggcctcgaggggagggctggagtgggcggccgtatacaaggaanctaacagttacagtacagaatacggcgcgtgtgagaaagggtaacgttcaaccatctacgaaagagattagattaacaaaagaactacactgtaactctagacaaatcgaacagacctaagaaaaccgagacacgggtcctagttaattagttaggaggttaagaaaacgtaaaaggaggtaaggaacttggggtgggtaggtacgtcgtttaggacg

SEQ ID NO: 361067 - DNA, 565 bp, Homo sapiens
  misc_feature: GZ8MTXP02JF75S.21.4.A04.1.454.CMB.2.raw
  modified_base (301)..(301): a, c, t, g, unknown or other
  modified_base (347)..(347): a, c, t, g, unknown or other
  modified_base (495)..(495): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcatcgaccacaacatggactggggtccncaggctccgaggggagggctggagtgggtcgccgtatacaaggaanctaaacagttacagtacagaaatacgggcgcgtctagtaggaaaagggtaaggttccaaccgtatcctacaaagataataggaattacaaaaaggtaacttcgaacttagtaatccgtagacaaaatgaaacagacctagaaaaccgngacacggtcgtagtattagttgtaggtagaacgaaaagtgtaaggataggtgggtagaagtcgtgtaacg

SEQ ID NO: 361068 - DNA, 582 bp, Homo sapiens
  misc_feature: GZ8MTXP02FS2S2.21.4.A04.1.454.CMB.2.raw
  modified_base (298)..(298): a, c, t, g, unknown or other
  modified_base (429)..(429): a, c, t, g, unknown or other
  modified_base (537)..(537): a, c, t, g, unknown or other
tcagtcgtcgctcgcacgaccggtgctcgatttagagtagtgatcaggggagctctgagagcggagccccagccccagaattcccaggtgtttcatttggtgataagcactgaacacagaggactcaccatggagtttgggctgagctgggttttccttgttgttatttacaaggtgtccagtgtgaggtgcagctggtggagtctgggggagacttggtccagcctggagggtccctgagactctcctgtgcagcctctgcattcaccttcagtgaccacaacatggactgggtccnccaggctccgagggagggctgggagtgggtcgcgtatacgaaggaagctaacagttacagtacagatacggcgcgtctgtagaaaagggaggttcaccatctacaaagagatgaattaacgaaaagaactnaacttgtaatctagaactaaaagtagaaacacgacctaaacggaaaacccggaggaaccgaccgggtacgtagttaagttagttggtaacggtaaagaaacgaaaagnggttaaggaagttaggtacgggtaggtagtacgtggtacgtaacg

SEQ ID NO: 361069 - DNA, 534 bp, Homo sapiens
  misc_feature: GZ8MTXP02GUCMC.21.4.A04.1.454.CMB.2.raw
  modified_base (201)..(201): a, c, t, g, unknown or other
  modified_base (292)..(292): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaagcctggccaggcctcccaggttcctnatctatgcgtcgggtaccccacgaggggcccagtggacatccccagacaggttcagtggcaggtcgggctggggacagtacttcactctacatcattagcagactggacgcctagaagtattcgacagtagtattactgtcagacagtataggtaagttcacttctgtcgttacggaccgaaagggaccaaaggtaacgaaagtacgaaaacgtacgtggtcggactacgacactatcttcg

SEQ ID NO: 361070 - DNA, 616 bp, Homo sapiens
  misc_feature: GZ8MTXP02IT0U5.21.4.A04.1.454.CMB.2.raw
  modified_base (217)..(217): a, c, t, g, unknown or other
  modified_base (303)..(303): a, c, t, g, unknown or other
  modified_base (385)..(385): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccagcctgggagggtccctgagactctcctgtgcagcctctgcattcaccttcagtgaccacaacatggactgggtccnccaggctccgaggggaagggctggagtgggtcgccgtatacgaaggaaagctaacagttacagtacagaaatacggcgcgtntggagaaaagggacgttcaaccgtatctacgaaagagaatagaacttaccgaaaagtaacctacaaacttgtaaacttcgtagaacctaaaatcggaaaaccaggtaaccctaaaggaaaaacccgagggaaccgaaccgggtaccgtaggttaaatttacgttagggtaggtaaagaaaaccgaaaaggtagtaaggtaatgggttagggtacggtagcgtttaggaccg

SEQ ID NO: 361071 - DNA, 505 bp, Homo sapiens
  misc_feature: GZ8MTXP02GF1FX.21.4.A04.1.454.CMB.2.raw
  modified_base (200)..(200): a, c, t, g, unknown or other
  modified_base (290)..(290): a, c, t, g, unknown or other
  modified_base (397)..(397): a, c, t, g, unknown or other
  modified_base (436)..(436): a, c, t, g, unknown or other
  modified_base (441)..(441): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctnatctatgctgggtccccacagggcccagtggcatcccagacaggttcagtggcagtgggtctggggacagacttcactctcatcattagcagactgagcctgaagtntttacgctagtgtattactgtcagcagtatggaacgttnacctntgtcgttcggaccaagggaccaaaggtacgaaatacgaaacgaactgtgactagcaccatctcg

SEQ ID NO: 361072 - DNA, 536 bp, Homo sapiens
  misc_feature: GZ8MTXP02I06MV.21.4.A04.1.454.CMB.2.raw
  modified_base (202)..(202): a, c, t, g, unknown or other
  modified_base (292)..(292): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggcctcccaggttcccnatctatgctgggtccccagacgggcccacgtggccaactccccaagaccacggtttcaggttggctaggtcggggtctgggggacaggtaccttcactctcatcattagcagactggagcctgaagtattcgctagtgtattacgtgtcagcagtatggtaagttcacttctgtcgttcggacgtaaggaccgaaaggtagaaacgtacgaaacgaactgtcggactcggacacctatcttacg

SEQ ID NO: 361073 - DNA, 590 bp, Homo sapiens
  misc_feature: GZ8MTXP02JVJ29.21.4.A04.1.454.CMB.2.raw
  modified_base (202)..(202): a, c, t, g, unknown or other
  modified_base (291)..(291): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccnatctatgctgggtccccagacgggcccacgtggcactcccagacaggttcagtggcaggtgggtctggggacagtcttcactctcatcattagcagactgggacgcctagtaagtatttcggactaggtgttaacttactattcaagtctaagttagtacgggtaaacgtttccaaccgttcgttacggtccggtttaccgggacccgtaaacgggggaaccctaaaaggggttaagaaaacgttaggaaaaacccgtaacgtaaggtacgggctacggacctacctaagttcttacgg

SEQ ID NO: 361074 - DNA, 597 bp, Homo sapiens
  misc_feature: GZ8MTXP02HKMEV.21.4.A04.1.454.CMB.2.raw
  modified_base (202)..(202): a, c, t, g, unknown or other
  modified_base (294)..(294): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaggggaaangccaccctctcctgcagcctccagccaagaatatccagagctactacatacgcctggtaccagcagaagcctggccaggctcccaggttccnatctatgctggtcccagacggcccagtggcactcccagacaggttccaggtcggactaggtcgggtctggggactagtaccttcgaccttcacatcaattagctagacgtggagtccgtagaacgtatttcgactagttagtaactttacgtgtacagtctaagttagtaggtaaacgttcacccgttgttcggttaccggtttacggaacccgttaaaggggaaaccctaaaagggttaaactaaaagtaacgaaaaccggtaacgtaagtacggactacggaccaacccgtattcgttacg

SEQ ID NO: 361075 - DNA, 612 bp, Homo sapiens
  misc_feature: GZ8MTXP02G5ISL.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtcccgccaggctccgaggggaaggggctgggaggtgggtcggccgtagttacaagggaaagctaaacagttacagtacagaaatacggcgcgtctggtagaaaagggtagttcaaccgtatctacaaaagagatagaattacaaaagtaactacacttagtatctagaactaaaatgaaaccaggtaccctaaaggaaaaacccgagggaaccaacggggtaccgttagttaatttagttagggtaaggtaaacgaaaacgtaaaaaggtggtaagggtaaattgggtagggtacggtagtaccgttggtaacg

SEQ ID NO: 361076 - DNA, 594 bp, Homo sapiens
  misc_feature: GZ8MTXP02GVY10.21.4.A04.1.454.CMB.2.raw
  modified_base (362)..(362): a, c, t, g, unknown or other
  modified_base (425)..(425): a, c, t, g, unknown or other
  modified_base (431)..(431): a, c, t, g, unknown or other
  modified_base (440)..(440): a, c, t, g, unknown or other
  modified_base (500)..(500): a, c, t, g, unknown or other
  modified_base (555)..(555): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacatggacctggggtcccgccaggcctccgaggggaggggctgggaggtggggtcggccgtattacgaaaggaanctaaacagttacagtacagaatacgggcgcgtctaggtagaaaagggtacgttcaaccatcanaaaganatgaattanaaaacgactacacttgtactctagactaaaagtcgaaacagaccctaaaggaaaacccgngggaaccacgggtaccgtagttaatttagtaggtaggtaaacgaaacgaaaaggngtaacggaattgggtacgggtaggtagcgttaggtaacg

SEQ ID NO: 361077 - DNA, 537 bp, Homo sapiens
  misc_feature: GZ8MTXP02JAH17.21.4.A04.1.454.CMB.2.raw
  modified_base (260)..(260): a, c, t, g, unknown or other
  modified_base (282)..(282): a, c, t, g, unknown or other
  modified_base (503)..(503): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctctgtgcagcctntgcattcaccttcagtgaccanaacatggactgggtccgccaggcctccgaggggaaggggctgggagtgggtcggccgtatacgaaggaagctaaacagttacagtacagagtacggcgcgtctagtagaaaggaggttcaccatctacaagagatgaattacaaagactcactgtatctagacaaatgaacagactagaaacgagacacggctagtattagtggtagtaagacgtaaaagngtaggaagtggaggtacggagcgtaggtagaacc

SEQ ID NO: 361078 - DNA, 493 bp, Homo sapiens
  misc_feature: GZ8MTXP02JQGN5.21.4.A04.1.454.CMB.2.raw
  modified_base (198)..(198): a, c, t, g, unknown or other
  modified_base (285)..(285): a, c, t, g, unknown or other
  modified_base (304)..(304): a, c, t, g, unknown or other
  modified_base (384)..(384): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctccaggggaangccacctctcctgcagcctccagccagaatatccagagctactacatagcctggtaccagcagagcctggccaggctccaggttccnatctatgctgggtccccanagggccactggcatcccagacaggttcagtgcagtgggtctggggacaggtacttcactctcatcattagcagactgganctgaagtatttcgctagtgtattactgtctaggcagtatggtaagttcactctgtcgttcgccaaggaccaaggtacgaactagaaacgactgcggactgcacatctcg

SEQ ID NO: 361079 - DNA, 557 bp, Homo sapiens
  misc_feature: GZ8MTXP02IDV8I.21.4.A04.1.454.CMB.2.raw
  modified_base (257)..(257): a, c, t, g, unknown or other
  modified_base (262)..(263): a, c, t, g, unknown or other
  modified_base (268)..(268): a, c, t, g, unknown or other
  modified_base (271)..(272): a, c, t, g, unknown or other
  modified_base (279)..(279): a, c, t, g, unknown or other
  modified_base (281)..(281): a, c, t, g, unknown or other
  modified_base (289)..(289): a, c, t, g, unknown or other
  modified_base (292)..(292): a, c, t, g, unknown or other
  modified_base (295)..(295): a, c, t, g, unknown or other
  modified_base (305)..(305): a, c, t, g, unknown or other
  modified_base (307)..(307): a, c, t, g, unknown or other
  modified_base (310)..(310): a, c, t, g, unknown or other
  modified_base (313)..(313): a, c, t, g, unknown or other
  modified_base (332)..(332): a, c, t, g, unknown or other
  modified_base (361)..(361): a, c, t, g, unknown or other
  modified_base (398)..(398): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttcgtgttaggttatttacaaggtgtccagtgtgaggtgcagctggtggagtcgtgggggagacttggtccagcctggagggtccctgagactctcctgtgcngctcnncatcnctnncacacanangcgtggcncgngcncgagggaggngnggnggnggtcgcgtagtagaagaanactaacgagtacagacagaacgtcggcgngtcgtagagaaaggtacgtccactatacagaagagtntagtaataacgaaaactactacgtacttagtacttcagacgtaaagtaacgaaacgaacgacgaacgaaacggaacgaacgaacggtacgtagttagttagttagtaggtaagtaaacgaaagaagtaaggtagtaggtaggtaggtagtacgtagtag

SEQ ID NO: 361080 - DNA, 535 bp, Homo sapiens
  misc_feature: GZ8MTXP02JMNQJ.21.4.A04.1.454.CMB.2.raw
  modified_base (216)..(216): a, c, t, g, unknown or other
  modified_base (257)..(257): a, c, t, g, unknown or other
  modified_base (380)..(380): a, c, t, g, unknown or other
  modified_base (409)..(409): a, c, t, g, unknown or other
  modified_base (467)..(467): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtacngcctctgcattcaccttcagtcgaccacaacatggactgggtccgccaggctccgaggggaagggctgggagtgggtcgccgtatacgaaggaacgctaacagttacagtacagatacgggcncgtctgtagaaaaggtaggttcaccatcncaagagatgattacaaagactcactgtatctagacaaatgaaacagcctagaaaacgnggacacgcgtagtattagttgaggtaagacgaaaagtgaggaatggtaggtacggtagctgtacgaac

SEQ ID NO: 361081 - DNA, 579 bp, Homo sapiens
  misc_feature: GZ8MTXP02IQV6S.21.4.A04.1.454.CMB.2.raw
  modified_base (304)..(304): a, c, t, g, unknown or other
  modified_base (348)..(348): a, c, t, g, unknown or other
  modified_base (464)..(464): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacttggtccagcctggagggtccctgagactctcctgtgcagcctctgcattcaccttcagtgacccacaacatggactggggtcccncaggctcgaggggagggctggagtgggtcgcgtatacaaggaanctaacagttacagtacagaatacggcgcgtctggtagaaagggtaacgttcaacctatctacaaagagatagaattacgaaaagactacaacttgtaatctagacaaaatgaaacngacctaaggaaaacccgaggaccacgggtccgtaggttaattacgttaggtaggtaagaaaacgaaaaggtaaggtgggtaagttggggttaggtacggttagcgttaggtacgg

SEQ ID NO: 361082 - DNA, 619 bp, Homo sapiens
  misc_feature: GZ8MTXP02JL1US.21.4.A04.1.454.CMB.2.raw
  modified_base (201)..(201): a, c, t, g, unknown or other
  modified_base (295)..(295): a, c, t, g, unknown or other
  modified_base (407)..(407): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttcgtctccgaggggaaanagccacctctcctgcagcctccagccagaatatccagagctactacatacgcctggtaccagcagaacgcctggccaggcctcccgaggttccnatctatgctcgggcccagacgggcccagtggcactcccaagacacggttcaggtcgcgtaggtgggtctggggactaggtaccttcactctacatcattagcagactggacnccgtagaacgtattacgactagtgttaattacgtgtacagactaagtagtagggtaagttcctaaccgttcgttcggttaccggtttaccgggaacccggtaaaacgggggtaaacccgtaaaaggggttaaaccgtaaaacgtaacggtaaaaccggtaaacgtaagggtacgggtacgttacggacctaaccggtaacttcggtttaccg

SEQ ID NO: 361083 - DNA, 581 bp, Homo sapiens
  misc_feature: GZ8MTXP02JI30U.21.4.A04.1.454.CMB.2.raw
  modified_base (279)..(279): a, c, t, g, unknown or other
  modified_base (284)..(284): a, c, t, g, unknown or other
  modified_base (301)..(301): a, c, t, g, unknown or other
  modified_base (344)..(344): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtnaccanaacatggactgggtccncaggctcgagggagggctggagtgggtcgcgtatacaaggaanctaaacagttacagtacagaatacggcgacgtctagtagaaaaggaagttcaaccgatctacaaagagatagaattacaaaagactacactagtaatctagacaaaatgaaacacggacctaaggaaaaacccggaggaaccaaccggggtcctagttaagttaattgggtaacggtaacgaaaacgaaaaagaggtaaggaaagttgggtagggtacggtaaagcgttagtaacgg

SEQ ID NO: 361084 - DNA, 548 bp, Homo sapiens
  misc_feature: GZ8MTXP02HH5QS.21.4.A04.1.454.CMB.2.raw
  modified_base (382)..(382): a, c, t, g, unknown or other
  modified_base (472)..(472): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacagtggactggggtccgccaggctccgaggggaagggctggagtgggtcggccgtattacgaaggaaagctaacagttacagtacagaatacggcncgtctgagaaaggagttcacatctacaaagagatgaattacaaagaactcaactgtatctagacaaatgaaacacgacctagaaaaccgngaacgacggtccgtagttattatgtaggtagaacgaaaagtagaaggtaagtggttaggtacggtagcgttagacg

SEQ ID NO: 361085 - DNA, 574 bp, Homo sapiens
  misc_feature: GZ8MTXP02G3L5X.21.4.A04.1.454.CMB.2.raw
  modified_base (199)..(199): a, c, t, g, unknown or other
  modified_base (293)..(293): a, c, t, g, unknown or other
  modified_base (380)..(380): a, c, t, g, unknown or other
  modified_base (423)..(423): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatacgcctggtaccagcagaacgcctggccaggcctcccgaggttcctnatctatgctggtccccagacggcccacgtggcactcccagacacggttcagtcggcaggtcggtctggggacaggacttcgacttcncactctattacgacagtacgtggagccgtagagtaatttcggntagttgttaattacgtgtacagtacgtaagtagtaggtaaagttctaccttcgttcggtccgttacggacgtaaaggggaccgtaaagggtaacgaaaagtacggaaaaccgtagtaaggtcggacgtacggaccaaccgtatcgtttacg

SEQ ID NO: 361086 - DNA, 596 bp, Homo sapiens
  misc_feature: GZ8MTXP02IMTI1.21.4.A04.1.454.CMB.2.raw
  modified_base (198)..(198): a, c, t, g, unknown or other
  modified_base (231)..(231): a, c, t, g, unknown or other
  modified_base (288)..(288): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaangccaccctctcctgccagctccagccagaatanccagagctactacatagcctggtaccagcagaagcctggccaggctcccaggttccncatctatgctcggtcccagacgggccacgtggcactcccagactaggttcagtggcaggtgggtctggggacaggtacttcactctactatctagtagcgtagtacgacgactcgtaagtaagttcgtcgacgttagttacgtttacgttacgttcgtagtacgtaagtaagttaggtaacggttactaccgtacgttcgttcggttccgggtaccggtaacgggtaaacggtaaacggtaaaaggtaaaggtaacgtaaaacgtaaacgtacggtggtacgtacgacgacgtactcgttacgttccg

SEQ ID NO: 361087 - DNA, 525 bp, Homo sapiens
  misc_feature: GZ8MTXP02JYWO6.21.4.A04.1.454.CMB.2.raw
  modified_base (302)..(302): a, c, t, g, unknown or other
  modified_base (378)..(378): a, c, t, g, unknown or other
  modified_base (465)..(465): a, c, t, g, unknown or other
  modified_base (475)..(475): a, c, t, g, unknown or other
  modified_base (482)..(482): a, c, t, g, unknown or other
  modified_base (490)..(490): a, c, t, g, unknown or other
  modified_base (500)..(500): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtccnccaggctccgaggggagggctgggagtgggtcgccgtatacaaagaagctaacagttacagtacagaatacggcgngtctgtagaaagggagttcaaccagtctacaagagatgattacaaagactcgactgtatcagacaaatgaacagccctagaaaccgngacacgcgtntattagngttagganaacaaaaggngtgaatggtggtacggagctgtacg

SEQ ID NO: 361088 - DNA, 537 bp, Homo sapiens
  misc_feature: GZ8MTXP02IRLIR.21.4.A04.1.454.CMB.2.raw
  modified_base (370)..(370): a, c, t, g, unknown or other
  modified_base (383)..(383): a, c, t, g, unknown or other
  modified_base (509)..(509): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgacccacaacatggactggggtcccgccaggctccgaggggagggctggagtgggtcgcgtatacaaggaaagctaacagttacagtacngatacggcgcgtngtagaaaggagttcaccatctcaaagagatgaattacaaaagactcaacttgtaatctgacaaaatgaacagcctaagaaaaccgaggacacggccgtagtattagttggtaggtagaacaaaagngtaaggatggtgggtagtacgcgtagtg

SEQ ID NO: 361089 - DNA, 558 bp, Homo sapiens
  misc_feature: GZ8MTXP02G8P25.21.4.A04.1.454.CMB.2.raw
  modified_base (301)..(301): a, c, t, g, unknown or other
  modified_base (348)..(348): a, c, t, g, unknown or other
  modified_base (441)..(441): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccncaggctccgaggggagggctggagtgggtcggccgtatacaaggaanctaacagttacagtacagaatacggcgcgtctaggtagaaaagggtagttccaacccgtatctacgaaagtagatagaattacaaaagactanactgtatcgagacaaaatcgaaacagacctaaggaaaaccgagacacggcgtagtattagttaggaggtaacaaacgaaaagtaggtggaattggtggggttacgagtcgtggtacg

SEQ ID NO: 361090 - DNA, 593 bp, Homo sapiens
  misc_feature: GZ8MTXP02HB5Z3.21.4.A04.1.454.CMB.2.raw
  modified_base (309)..(309): a, c, t, g, unknown or other
  modified_base (366)..(366): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccaggcctgggagggtccctgagactctcctgtgcagcctctgcattccaccttcagtcgacccacaacagtggactggggtcccnccaggctccgaggggacggggctgggagtcggggtcgaccgtattacgaaaggaacnctaaacgagttacaggtacaggaatacgggcgcgtcgtaggtaggaaaagggtaacgttcacccgaatcctacgaaagagatagaacttacaaaagtactacacttagtatcgtagacaaaagtgaaactagacccaaggaaaacccgaggaccacgggaccgtagttatagttggacgtagaaacgaaaggagtggaagtggtacggtaggtacgtcgtggtaacg

SEQ ID NO: 361091 - DNA, 560 bp, Homo sapiens
  misc_feature: GZ8MTXP02GH73Q.21.4.A04.1.454.CMB.2.raw
  modified_base (200)..(200): a, c, t, g, unknown or other
  modified_base (209)..(209): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggcctcccaggttcctcatctatgctcgggtcccacgagggcccactggcactccccagacacggttcagtggcaggtgggtctggggacagacttcgactctcatcattagcagactgacgcctagaagtatttcgctagtgttattactgtacagtacagtagtaggtaactttcaccttcgtgttccggttacggaccgtaaaaggggaccgtaaaagggtaacgaaaagttacggaaaaccggtacgtaaggtcggactacggacctacctattaccgttcg

SEQ ID NO: 361092 - DNA, 627 bp, Homo sapiens
  misc_feature: GZ8MTXP02JQJ4G.21.4.A04.1.454.CMB.2.raw
  modified_base (133)..(133): a, c, t, g, unknown or other
  modified_base (435)..(435): a, c, t, g, unknown or other
  modified_base (627)..(627): a, c, t, g, unknown or other
tcagtcgtcgctcgcacgaccggtgctcgatttagagtagtgatcaggggagctctgagagcggagccccagccccagaattcccaggtgttttcatttggtgatcagcagtgaacacagaggactcaccatnagtttgggctgagctgggttttccttgttgttattttacaaggtgtccagtgtgaggtgcagctggtggaggtctgggggagacttggtccaggccctggagggtccctgagactctcctgtgcagcctctgcattcaccttcagtgaccacaacatggactggggtccgccgaggctccgaggggaaggggctgggagtgggtcggccgtatacgaacggaagctaaacagtacaggtaccaggaaagtctacggcgtactaggtagaaagggaaacggttcaaccgatacgtacaaaganatagaattacgaaacgtaactacaactacgtatactacgaacaaagtacgaaacgaacggacccgtaacggaaaacccggaaggaaccgtaaccgggtaccgttaggttccaactttaggttacggtaagggttaacgaaaacggtaaaagggtggtaagggtcgtagggttagggtacgggtacggtacgn

SEQ ID NO: 361093 - DNA, 580 bp, Homo sapiens
  misc_feature: GZ8MTXP02JEPA8.21.4.A04.1.454.CMB.2.raw
  modified_base (279)..(279): a, c, t, g, unknown or other
  modified_base (301)..(301): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtnaccacaacatggactgggtccncaggctccgaggggagggctggagtgggtcgcgtatacaaggaagctaacagttacagtacagaatacggcgcgtctgtagaaaagggagttcaaccgatctcaaagagatagaatacaaaagactacactgtactctagacaaaagtcgaaacaggtaccgtaacgaaaaacccggaggaacgaccgggtaccgttagttaagttacgttagggtacggtaaagaaacgtaaaaggaggttaaggaagttggtagggtaggtacgacgttaggtaacg

SEQ ID NO: 361094 - DNA, 690 bp, Homo sapiens
  misc_feature: GZ8MTXP02J228N.21.4.A04.1.454.CMB.2.raw
  modified_base (265)..(265): a, c, t, g, unknown or other
  modified_base (290)..(290): a, c, t, g, unknown or other
  modified_base (303)..(303): a, c, t, g, unknown or other
  modified_base (354)..(354): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctcngcattcaccttcagtgaccacaacntggactgggtccnccaggctccgaggggagggctggagtgggtccgcgtataacgaaggaaacnctaaacagttacagtacagaaacgtacggcgcgtctaggtaaggaaaagggtaacggttcccaaacctaagttacctaacgaaaaggagtaaataggtaaactttaaccgaaaaaggtaaccttaccgtaacttaggtaactaccttaggaacctaaaaaagtcgaaaacccgaacggaaccccgttaaagggaaaaaaccccgggacggaaacccgtaacccggggtccgttaggtttaaactttacggttacggtaacgggtaaaacgaaaacgtaaaaaggtgggtaagggtaaagttggggttaacggggtgttaacggccgttaggtaacg

SEQ ID NO: 361095 - DNA, 682 bp, Homo sapiens
  misc_feature: GZ8MTXP02JW0XY.21.4.A04.1.454.CMB.2.raw
  modified_base (193)..(193): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggtatttacaaggtgtcagtgtgaggtgcagngtggtggagtgtggggagacgttggtcgagcgtggacgggtccgtgagactctctgtgcacgcctctcgctacttctaccttctagtacgaccaacaacacgtaggacgtcgggtccggccgacggaccgtaccggacggggacggggcggtagggtagggtcggggtcgggtaccgtaacgttaacgaaacggaaagtaacgtaacgtaacgtaacgtaagtaacgagaaacgtaacggacgtcgtacgtaggtaggaaagggtaacgtacgtaacctactactacgaagaagagtagtaataacgtaaacgtaaactaactaacgtagtactacgtacgtaactaaataacgaaacgaacgaccgtaaacggaaaaccggaaacggaacggaaccggtaccggtacgttagttaagttaggttacggtaacgtaaacgtaaaagtaaggtaaggtaggtaggtagggtaggtacggtacgtagtacg

SEQ ID NO: 361096 - DNA, 581 bp, Homo sapiens
  misc_feature: GZ8MTXP02IWNYO.21.4.A04.1.454.CMB.2.raw
  modified_base (305)..(305): a, c, t, g, unknown or other
  modified_base (354)..(354): a, c, t, g, unknown or other
  modified_base (499)..(499): a, c, t, g, unknown or other
  modified_base (549)..(549): a, c, t, g, unknown or other
  modified_base (571)..(571): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacttggtccagcctgggagggtccctgagactctcctgtgcagcctctgcattcaccttcagtcgacccacaacatggactggggtccnccgaggcctcgaggggagggctgggagtgggcgccgtatacgaaggaanctaaacagttacagtaacagaatacggcgcgtctaggtaggaaaaggacggttcaaccgatctacaaagagtatgtaattacgaaaagaacctctaacttgtaacttactagacaaaaatcgaaactagacctaaggaaaaccgnggaccaacggtcgtagttaattagttggtacggtaagaaacgtaaaaggngtaaggatcggtaggtaggtancgttagtacg

SEQ ID NO: 361097 - DNA, 579 bp, Homo sapiens
  misc_feature: GZ8MTXP02H7HY7.21.4.A04.1.454.CMB.2.raw
  modified_base (304)..(304): a, c, t, g, unknown or other
  modified_base (495)..(495): a, c, t, g, unknown or other
  modified_base (535)..(535): a, c, t, g, unknown or other
  modified_base (547)..(547): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagcctgggagggtccctgagactctcctgtgcagcctctgcattcaccttcagtgaccacaacatggactgggtccncaggctcgaggggagggctggagtgggcggccgtatacgaaggaagctaaacagttaacaggttaacaggaaatacggcgcgtcgtaggtagaaaagggtaggttaccaaccgtatctacaagagtatgaattacaaagtaactacacttgtatctagacaaatagaaacagaccctaagaaaaacccggnggaaccacgggtccgtagttaactttagtggtacggtaanaaacgaaaaggngtaaggatggtacgggtagtagtcttaggacg

SEQ ID NO: 361098 - DNA, 577 bp, Homo sapiens
  misc_feature: GZ8MTXP02H3HS7.21.4.A04.1.454.CMB.2.raw
  modified_base (311)..(311): a, c, t, g, unknown or other
  modified_base (391)..(391): a, c, t, g, unknown or other
  modified_base (427)..(427): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggacggggtccctggagactctccctgtgcagccctctgcattcacccttcagtcgaccacaacatggactggggtccnccaggctccgaggggaaggggctggagtgggtcgccgtatacaaggaaagctaacagttacagtaacagaaagtacggcncgttcaggtagaaaaggtacgttccaccgatcctanaaagagactgaattaccgaaagaaactcaacttgtaacttcagacaaatagaaacaacgacgacgaaaccgaacgaacgaacggaccgtagtattagttagtagtacgaacgaaagaagtaagagtaggtaggtaggtagacgtagtacg

SEQ ID NO: 361099 - DNA, 687 bp, Homo sapiens
  misc_feature: GZ8MTXP02G7ALJ.21.4.A04.1.454.CMB.2.raw
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgcgcagcctctgcattcaccttcagtcgaccacaacatggactggggtccncaggctccgaggggagggctgggagtggggtcgcgtatacgaaggaagctaacagttacagtacaggaactacgggcgtcgtctaggtagaaaaggggtacgttccaaacccgtatcctaacgaaaggagtagtagtaaattaaccgaaaaagtaaccttaccaaacgttaggtaacttccgtaggaacctaaaaagttcggaaaaaccaacggtacccgtaaaacgggaaaaaaccccggaggggaaacccaacccgggggtacccgttaaggttaaatttaacggttagggtaacgggttaaaacgaaaaccgtaaaaaagggtgggttaaggggtaagttcggggttagggggtaggtaacggtcggttaggtaaccgg

SEQ ID NO: 361100 - DNA, 554 bp, Homo sapiens
  misc_feature: GZ8MTXP02HLHLR.21.4.A04.1.454.CMB.2.raw
  modified_base (302)..(302): a, c, t, g, unknown or other
  modified_base (517)..(517): a, c, t, g, unknown or other
  modified_base (527)..(527): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacacatggactgggtcccnccaggcctccgaggggaagggctggaggtgggcgccgtatacgaaggaaagctaaacagttaacagtaacagaaatacgggcgcgtctaggtagaaaagggaagttcaacctatcacaaagagaatgaattaacaaaagtaactacaacttgtaattctagacaaaatgaaacagacctaagaaaacccgagaacacggctagtatagtgagtanaacgaaaagngtaagatggtaggtgtagcgtagtacg

SEQ ID NO: 361101 - DNA, 580 bp, Homo sapiens
  misc_feature: GZ8MTXP02IPG46.21.4.A04.1.454.CMB.2.raw
  modified_base (263)..(263): a, c, t, g, unknown or other
  modified_base (285)..(285): a, c, t, g, unknown or other
  modified_base (349)..(349): a, c, t, g, unknown or other
  modified_base (405)..(405): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctgggggagacttgggtccagcctggagggtccctgagactctcctgtgcagcctntgcattcaccttcagtgaccanaacatggactgggtccgcaggctccgaggggagggctgggagtgggtcgcgtattacaaggaanctaacagttacagtacagaatacggcgcgtctggtagaaaggagttcaccatctanaaagagatgattacaaagactacacttgaatctagacaaaagtgaaactaggacctaaggaaaaccgaggaaccgaacgggtaccgtaggttaatttacgttaggtagggttaacgaaaacgaaaaaggtaggtaagggtagttaggttaggggtaggtaggtcgttaggtacgg

SEQ ID NO: 361102 - DNA, 594 bp, Homo sapiens
  misc_feature: GZ8MTXP02HE88F.21.4.A04.1.454.CMB.2.raw
  modified_base (306)..(306): a, c, t, g, unknown or other
  modified_base (358)..(358): a, c, t, g, unknown or other
  modified_base (364)..(364): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgagtgcagctggtggagtcgtgggggagacgttggtccagcctgggacgggtccctgagactctcctgtgcagcctctgcattcaccttcagtcgaccacaacatggactggggtcccnccaggctccgaggggaagggctggaggtgggtcggccgtatacgaaggaaancctaanagttaacagtaacagaaactcggcgcgtactgaagaaaagggagttccaacccgatctacgaaaagagatagtaattacaaaacgtaactacacgtagttaatcagacaaaagtcgaaacacgaccgtaaggaaaaccgaggaccaacggtccgtagttatttacgtaggtaggtaacgaaactaaaaggaggttaaggtagtaggttaggtaggtagtacgtaggtacg

SEQ ID NO: 361103 - DNA, 562 bp, Homo sapiens
  misc_feature: GZ8MTXP02GYFDQ.21.4.A04.1.454.CMB.2.raw
  modified_base (201)..(201): a, c, t, g, unknown or other
  modified_base (239)..(239): a, c, t, g, unknown or other
  modified_base (293)..(293): a, c, t, g, unknown or other
  modified_base (471)..(471): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccaganctactacatagcctggtaccagcagaagcctggccaggcctcccgaggttcccncatctatcgctcgggtccccacgacgggcccacgtggcactccccaagacacgggttcaggtggactaggtcgggtctgggggacaggtaccttcactctacatcattagcagactggacgcctagaagtattcgactagtgttattactgtacagcagtagtaggtaagttcacttntgtccgttcggacgtaaagggacctaaagggtaacgaaagtacggaaaacgtaacgtaaggtcggtactacggaccaaccgtagtacttcg

SEQ ID NO: 361104 - DNA, 541 bp, Homo sapiens
  misc_feature: GZ8MTXP02JBBK3.21.4.A04.1.454.CMB.2.raw
  modified_base (306)..(306): a, c, t, g, unknown or other
  modified_base (475)..(475): a, c, t, g, unknown or other
  modified_base (513)..(513): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacttgggtccagcctgggagggtccctgagactctcctgtgcagcctctgcattcaccttcagtgaccacaacatggactggggtccnccaggctccgaggggaaggggctgggagtgggtcgccgtatacaaggaagctaacagttacagtacagaatacggcgcgtctgtagaaaggagttcaccgatctacaaagagatgaattcaaaagactcactgtatctagacaaatgaaacagaccctaagaaaaccgnggaacacggcgtagtattagtggtagtagaacaaaagngtggaatggtaggtcgtagcgtagtacg

SEQ ID NO: 361105 - DNA, 569 bp, Homo sapiens
  misc_feature: GZ8MTXP02H7KEY.21.4.A04.1.454.CMB.2.raw
  modified_base (257)..(257): a, c, t, g, unknown or other
  modified_base (302)..(302): a, c, t, g, unknown or other
  modified_base (420)..(420): a, c, t, g, unknown or other
  modified_base (425)..(425): a, c, t, g, unknown or other
  modified_base (457)..(457): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagcgtccctgagactctcctgtgcngcctctgcattccaccttcagtgaccacaacatggactgggtccnccgaggcctccgaggggaggggcgtgggaggtggggtcggaccgtattacgaaagggaaagctaacgagttacagtacagaaagtacggcgcgtcgtagtagaaagagtcacgatcanaaganatgaattacaaaagactcactgtaatctaganaaactgaaactagacctaaggaaaaccgaggacctaacggccgttagttattagtagtaggtaagtaacaaaagggtaagtgggaaattcgggtaggtacggtagtacgtgg

SEQ ID NO: 361106 - DNA, 592 bp, Homo sapiens
  misc_feature: GZ8MTXP02GZ68L.21.4.A04.1.454.CMB.2.raw
  modified_base (306)..(306): a, c, t, g, unknown or other
  modified_base (426)..(426): a, c, t, g, unknown or other
  modified_base (548)..(548): a, c, t, g, unknown or other
  modified_base (559)..(559): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaacccacaacatggactggggtcccncgaggcctcgaggggagggctgggagtgggcgccgtagtacaaggaagctaacagttacagttacagaatacggcgcgtctggtagaaaaggaagttccaaacccgatcctacgaaaganataggaatttaccgaaaagtaaccttacaacgttgtaattctacggaactaaaagtgaaaccagacccgtaagaaaacccggagggaccacgggccgttagtactttagtagtacgggtaanaacgaaaaggngtaaggaatgggttagggtcgtagcgttgtacg

SEQ ID NO: 361107 - DNA, 695 bp, Homo sapiens
  misc_feature: GZ8MTXP02IG2TT.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggaggtcgtgggggagacttggtccagccgtgggagggtccctgagactctcctgtgcagcctctgctattcaccttcagtcgaccacaacatggactggggtcccgccgaggcctccggaggggaaggggctggggaggtggggtccggccgttaagtaacgaaacggaaaagtctaaacgtagttacaagtaacaggaaactacggggcgtcgtacgtggtaggaaaagggtacggttccaaccgtatctacgaaagtagtagttaggaaacttaacgaaaaagtaccttaccacgtttaagtacttccgtagaacctaaaagtccggaaaacctacggtacctaaaacggaaaacccgggacggaacccgtaccggggtaccgtttagtttaaagttaggtttaggaacgggttaaagaaaaacgttaaaaggggtggttaagggtaaagttgggggttacgggtagggtaaaccgtcggtttagtaaccgg

SEQ ID NO: 361108 - DNA, 776 bp, Homo sapiens
  misc_feature: GZ8MTXP02G64GJ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggccgtgggacgggtccctgagacctctcctgtgcacgcctctgctattcaccttcagtcgaccaacaacagtcggactcggggtcccgccgaggcctaccggaagggggaacggggcgtaggggagggttcggggtaccggtaccgttaagttaacgaaacggggaaaacgtaccgtaaacgtagttaacgaaggttaacgaggtaaacgtacggggccgtacgtcgtaggtaacggaaaagggtacgttccaaacccgtatccgtacgaaaggtagacgttaagtaactttaaccgaaaaacgtaccttacgtaaaccgtttaggttaacttaccgtaacgggtaaaccctaaaaaagttcggaaaacccgtaaccggtaaaccccgttaaaacggggaaaaaaccccgggagggaaaacccccgtaccgggggttaacccgtttaaggttaaacgtttaaggtttaacggggtaagggtaaaacgaaaacgaaaaaggtggtaagggtataggggttacgggtagaacggttccgtaggtaaccg

SEQ ID NO: 361109 - DNA, 547 bp, Homo sapiens
  misc_feature: GZ8MTXP02G6447.21.4.A04.1.454.CMB.2.raw
  modified_base (304)..(304): a, c, t, g, unknown or other
  modified_base (377)..(377): a, c, t, g, unknown or other
  modified_base (478)..(478): a, c, t, g, unknown or other
  modified_base (515)..(515): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacatggactggggtccncaggctccgaggggagggctggagtgggtcgcgtatacgaaggaagctaacagttacagtacagaatacggcncgtctggagaaaagggtaggttcaacccgatctacaaagagactagaattaccgaaaagtactacactagtatctgacaaatgaacagtacagaaaaccgngacacggctagtattatggtagtaagaacgaaaaggngtggaatcgggtaggtacggtagctaggtacg

SEQ ID NO: 361110 - DNA, 586 bp, Homo sapiens
  misc_feature: GZ8MTXP02JT51U.21.4.A04.1.454.CMB.2.raw
  modified_base (360)..(360): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggacgggtccctgagactctcctgtgcagcctctgcattcaccttcagtgaccacaacatggactggggtccgccaggcctaccgaggggaaggggctgggagtggggtcgaccgtatacgaaggaaanctaacagttacagtaacagaactacggcgcgtctagtaggaaaagggacgttcaaccatacctacaaagagatagtaaattacaaaagtacctacacttgtaactctagaacaaatgaaaccagaccctaaagaaaccgagaccacggcgttagttatagttggaggtaacgaaacgtaaaagtagggtggtaagtcggttaggggtagtaggcctttaggaacgg

SEQ ID NO: 361111 - DNA, 590 bp, Homo sapiens
  misc_feature: GZ8MTXP02IMAB7.21.4.A04.1.454.CMB.2.raw
  modified_base (202)..(202): a, c, t, g, unknown or other
  modified_base (295)..(295): a, c, t, g, unknown or other
  modified_base (376)..(376): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctccaggctcagaaaccaccggagaaattgtgttgacgcagtctccaggcaccctgtctttgtctccgaggggaaangccaccctctcctgcagctccagccaagaatatccagagctactacatagcctggaccagcagaacgcctggccaggcctcccgaggttcccnatctatcgctcgggtcccaagacggcccacgtggcactcccagactacggttcaggtcgctaggtcgggttctggggaacnggtacttcaccttcacatacattacgcagactgggactcctagaacgtagttcgactaggttagttattacgtgtacagtactagtagtacggtaacgttcaaccgttgtacgttccggtttaccggaccgtaaaacgggggtacctaaaagggttaacgaaaacgtacggaaaacgtacgtggtacgacgttacgactacctattccgttacg

SEQ ID NO: 361112 - DNA, 582 bp, Homo sapiens
  misc_feature: GZ8MTXP02IX3O4.21.4.A04.1.454.CMB.2.raw
  modified_base (291)..(291): a, c, t, g, unknown or other
  modified_base (310)..(310): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccacctctcctgcagctccagccagaatatccagagctactacatagcctggtaccagcagaagcctggccaggcctcccaggttcccnatctatgctcgggtccacngggcccactggcactcccagacaggttcagtggcagtgggtctggggacagacttcactctcatcattagcaggactgacgcctagaacgtatttcgctagttgttattactgtacagctagtagtaggtaagttccgtaccttcgtaggttcccgtttacgggacccgtaaaacggggtacccgtaaaagggttaacgaaaacgttaacggaaaacccggttaacgtaagggttacggtacttacgaccgtaacccgtattcccgtttacg

SEQ ID NO: 361113 - DNA, 616 bp, Homo sapiens
  misc_feature: GZ8MTXP02GTJL8.21.4.A04.1.454.CMB.2.raw
  modified_base (312)..(312): a, c, t, g, unknown or other
  modified_base (361)..(361): a, c, t, g, unknown or other
  modified_base (366)..(366): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttgggtccagccgtgggacgggtcccctggagactctcctgtgcagcctctgctattcaccttcagtgaccacaacagtggactggggtccnccgaggcctcgaggggagggctggagtcgggtcgcgtatacgaaggaanctaanagttacagtacagaatacggcgacgtctaggtagaaaggagttccaacctatctacaaaggagatagtaacttaacaaaagtacctctaacgtagtatcgtagaactaaaatacggaactacgaccgtaaaacggaaaacccggagggaaccgtaaccgggtacgtttaaggttaatttacggttaggtaacgggtaaaacaaacgtaaagggtgtaaggtagttgggtacggtagtacgtcgtagtacg

SEQ ID NO: 361114 - DNA, 499 bp, Homo sapiens
  misc_feature: GZ8MTXP02JQW0W.21.4.A04.1.454.CMB.2.raw
  modified_base (200)..(200): a, c, t, g, unknown or other
  modified_base (365)..(365): a, c, t, g, unknown or other
  modified_base (386)..(386): a, c, t, g, unknown or other
  modified_base (396)..(396): a, c, t, g, unknown or other
  modified_base (464)..(464): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctccccaggttcctcatctatgctgggtcccacagggcccactggcatcccagacaggttcagtgcaggtgtctgggacagacttcactntcatcattagcagactggacncctgaaagtnttacgcagtgttattactgtcagcagtatggaattcactctgtcgttcggccaagggaccaaaggtanaaaatacgaaacgactaagtggctgcaccatctcg

SEQ ID NO: 361115 - DNA, 538 bp, Homo sapiens
  misc_feature: GZ8MTXP02FL48K.21.4.A04.1.454.CMB.2.raw
  modified_base (215)..(215): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctgggagggtccctgagactctcctgtgcagcctctgcattcaccttcagtgaccacaacatggactggggtccgccaggctccaggggaaggggctggagtgggtcgccgtattacaaggaaagctaaacagttacagtacagaaatacggcgcgtctgtgaaaaggaaggttcaacccatctcaaagagatgattcaaaaagactacactgaatctagacaaaatgaaacagcctagaaaaaccgaggacacgggccgtagtatttatgtaggtagaacaaaagagtggaatggtggtgtagctaggcg

SEQ ID NO: 361116 - DNA, 591 bp, Homo sapiens
  misc_feature: GZ8MTXP02GOSNG.21.4.A04.1.454.CMB.2.raw
  modified_base (424)..(424): a, c, t, g, unknown or other
  modified_base (430)..(430): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacatggactggggtcccgccaggcctccgaggggaaggggctgggaggtgggtcggccgtagttacgaaaggaagctaacagttacagtacagaatacggcgcgtctgtagaaagggaacgttcaacccgatcctanaaaganagtgaattacaaaagaactacaactgtatctagacaaatcgaaacagacctaagaaaacccgaggaaccacgggtcctagttaattagttcggtacgggttaagaaacgaaaaaggtggtaagggtaagttcgggttagggtagggtaagcgttaggtacg

SEQ ID NO: 361117 - DNA, 625 bp, Homo sapiens
  misc_feature: GZ8MTXP02GP3K1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggacgggtccctgagactctcctgtgcagcctctgcattcaccttcagtgaccacaacatggactggggtccgccgaggctccgaggggaaggggctgggaggtgggtcggcgtattacgaaggaaagctaacagttacagtaacagaatacggcgacgtcgtgtaggaaaagggtaacggttcaacccgatcctacgaaagagaatgtaacttacaaaagtaacctacgtacctaggtatacctagacctaaaatacgaaacacgacctaaacggaaaaccgaggaaccgaacgggaccgttaggtaaatttagttaggtagggttaaagaaacgtaaaaggggtagtaaggtaggtaggggttacggtaggtacgtacggttacgtaaccgg

SEQ ID NO: 361118 - DNA, 636 bp, Homo sapiens
  misc_feature: GZ8MTXP02JTQ92.21.4.A04.1.454.CMB.2.raw
  modified_base (477)..(477): a, c, t, g, unknown or other
  modified_base (500)..(500): a, c, t, g, unknown or other
  modified_base (517)..(517): a, c, t, g, unknown or other
  modified_base (522)..(522): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttccgtgttaggttatttacaaggtgtccagtgtgaggtgcagctggtggagtcgtgggggagacgttggtccagcctgggagggtccctgagactctcctgtgcagcctctgcattccaccttcaggtcaccacaacatggactggggtcccgccgacggcctaccggagggggaacggggtcgtaggggaggtggggtacccgggtccgtaaagttaacgaaagggtaaaacgcctaaaacgtaggttacaaggttaacaggtaaacgtacgggcgtaccgtactggtaaaggaaagggtaacgttcaaccctatccgaanaaggagtatgtaataccgaaaanacttcaaacttgttacncgtanaacctaaagagaacaacgaccgaacgaaacgaacggacgacggaccgtagtagttagttagtaggtaacgtaacgaaagaagtaaggtagtaggtggtaggtagtacgtgtacg

SEQ ID NO: 361119 - DNA, 511 bp, Homo sapiens
  misc_feature: GZ8MTXP02FQF3S.21.4.A04.1.454.CMB.2.raw
  modified_base (198)..(198): a, c, t, g, unknown or other
  modified_base (379)..(379): a, c, t, g, unknown or other
  modified_base (458)..(458): a, c, t, g, unknown or other
  modified_base (495)..(495): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctccaggggaangccaccctctcctgcagctccagccagaatatccagagctactacatagcctggtaccagcagaagcctggccaggctcccaggttcctcatctatcgctggggtccccacgaggggcccacgtggccatccccagacaggttcagtggcaggtgggtctggggacaggacttcacttctnatcattgcagactggacgccgtagaagtatttcgctaaggttgttaattacgtgttcgagctagtatggaattcacctntgtcgtcggcaaggacaaggagaatagaaacgagtgngactcgcacgatctcg

SEQ ID NO: 361120 - DNA, 584 bp, Homo sapiens
  misc_feature: GZ8MTXP02JLVMP.21.4.A04.1.454.CMB.2.raw
  modified_base (372)..(372): a, c, t, g, unknown or other
  modified_base (497)..(497): a, c, t, g, unknown or other
  modified_base (512)..(512): a, c, t, g, unknown or other
  modified_base (546)..(546): a, c, t, g, unknown or other
  modified_base (553)..(553): a, c, t, g, unknown or other
  modified_base (571)..(571): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgagactctcctgtgcagcctctgcattccaccttcagtcgaaccacaacagtggactggggtcccgccgaggcctaccggaggggaacggggcgtgggaggtcggggtccggccgtaatacgaaggaanctaacagttacagtacagaatacggcgcgtacgtagtaggaaaagggtacggttcaaaccagtctacgaaagagatagaacttaacaaaagtactacacttagtaatctagacaaaatcgaaacngacctagaaaaccgngacacggtcgtatattagtggtaggtaacgaaanaaaaggngtggtaatcggttagggngtagcgttagacg

SEQ ID NO: 361121 - DNA, 539 bp, Homo sapiens
  misc_feature: GZ8MTXP02GMA8P.21.4.A04.1.454.CMB.2.raw
  modified_base (201)..(201): a, c, t, g, unknown or other
  modified_base (405)..(405): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccaagaatatccagagctaactacatacgcctggtaccagcaagaacgcctggccaggcctcccaggtcctcatctatgctcgggtcccacgacgggcccacgtggcatccccagacaggttccaggtgcgaggtcgggtctggggacaggtacttcactctcatcattagcagactggancctagaacgtatttcgactagtgtattacgtgtcgagtcagtatggtaagttcactcgtgtcgttacggacgaagggacgaaaggtaacgaaagtacgaaacgtacgtgacgtacgtcgactactactcgttcg

SEQ ID NO: 361122 - DNA, 580 bp, Homo sapiens
  misc_feature: GZ8MTXP02HAEJN.21.4.A04.1.454.CMB.2.raw
  modified_base (199)..(199): a, c, t, g, unknown or other
  modified_base (207)..(207): a, c, t, g, unknown or other
  modified_base (229)..(229): a, c, t, g, unknown or other
  modified_base (286)..(286): a, c, t, g, unknown or other
  modified_base (369)..(369): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcacctgtctttgctcgagggaaangccacctntcctgcagctccagccagaatntccagagctactacatagcctggaccagcagagcctggccaggcctccgaggttccncatctatgctcgggcccagaggcccacgtggccatcccaagcaggttcaggtggcaggtggctggggacagtaccttcactcnatcattacgcagactggacgtccgtagaagtactttcgctaggttgttaattacgttgtacgtagacgtaagttaagtaggtaaacgttcgaccttcgttcgttacggttaccggaccgtaaaggggaaccgtaaaagggtaaacgtaaaagtacggtaaaaccgtaacgttaagggtacggtacgtcggacctaacgtacttcgtttacg

SEQ ID NO: 361123 - DNA, 600 bp, Homo sapiens
  misc_feature: GZ8MTXP02FT05L.21.4.A04.1.454.CMB.2.raw
  modified_base (306)..(306): a, c, t, g, unknown or other
  modified_base (354)..(354): a, c, t, g, unknown or other
  modified_base (360)..(360): a, c, t, g, unknown or other
  modified_base (421)..(421): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtcgacccacaacatggactggggtcccncgaggctccgaggggagggctggaggtgggtcgcgtatacgaaggaanctaaanagttacagtaacagaatacggcgcgtctaggtaggaaaaggtaggttccaaccgatcctanaagtagatagaacttacaaaagtactacgactgtactctagaaccaaaatcggaaacaggtaccctaaaggaaaacccggaggaacaccgggtaccgttagttatttacgttagggtacggtaaagaaacaaaaggtggtaaggtaacgtgggtacggggtggtaagcgttaggtaacg

SEQ ID NO: 361124 - DNA, 590 bp, Homo sapiens
  misc_feature: GZ8MTXP02HL5O2.21.4.A04.1.454.CMB.2.raw
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacatggactggggtcccnccaggctccgaggggagggctggagtgggtcgcgtattacaaggaagctaacagttacagtacagaatacggcgcgtctgacgaaaggagttcaccatactacaagagatgattacaaagactacactgtaatctagacaaaatcgaaacacgaccctaagaaaaacccggacggaaaccgtaaccgggtacccgttaggttaatttaacgttacggtacgggtaaagtaaacgaaaaaggagttaagggaagttaggtgggtaaggtcgtacgttacgtaacgg

SEQ ID NO: 361125 - DNA, 560 bp, Homo sapiens
  misc_feature: GZ8MTXP02GNUGJ.21.4.A04.1.454.CMB.2.raw
  modified_base (308)..(308): a, c, t, g, unknown or other
  modified_base (423)..(423): a, c, t, g, unknown or other
  modified_base (475)..(475): a, c, t, g, unknown or other
  modified_base (491)..(491): a, c, t, g, unknown or other
  modified_base (532)..(532): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccaggccctgggaggggtccctgagactctcctgtgcagcctctgcattcaccttcagtgaccacaacatggactggggtcccncaggctccgagggagggctggagtgggtcgccgtatacgaaggaaagctaaacagttacaggtaacaggaaatacgggcgcgtctaggtagaaaaggaggttcaaccgatcctanaaagagatgaattacaaaagaactcgaactgtaatctagacaaaatgaaacngacctaagaaaaccgnggaaccaggccgtagtattagtggtagtaagaacaaaaggngttggaattgggtggtacgtagcgtaga

SEQ ID NO: 361126 - DNA, 678 bp, Homo sapiens
  misc_feature: GZ8MTXP02HPHOQ.21.4.A04.1.454.CMB.2.raw
  modified_base (201)..(201): a, c, t, g, unknown or other
  modified_base (231)..(231): a, c, t, g, unknown or other
  modified_base (293)..(293): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaaangtcacctctcctgcagctccagccagaatntccagagctaactacatacgcctggtaccagcagaacgcctggccaggcctcccaggttccncatctatcgctcgggtccccagacgggccacgtggacacgtcccagactaggttcagtggcgtaggttcggggtctgggggacaggtaccttccgaacttctacactctaattaggctaacggacgttgggacgtccgttaggaaacgtacgtttcgacgtaggtttacgtttatttaacgttggtactaaggtacctaaggttagttacggggtaaacgtttccctaaccgtttacggttacggtttcccgggtttaccgggaacccgggtaaaaccgggggtaaacccgttaaaaggggttaaactaaaaacgtaaccgggtaaaaccgtaaacggttaacgggtaggtaccgttacggaccctaaccgtactttcgtttacg

SEQ ID NO: 361127 - DNA, 535 bp, Homo sapiens
  misc_feature: GZ8MTXP02HOPU7.21.4.A04.1.454.CMB.2.raw
  modified_base (214)..(214): a, c, t, g, unknown or other
  modified_base (300)..(300): a, c, t, g, unknown or other
  modified_base (354)..(354): a, c, t, g, unknown or other
  modified_base (375)..(375): a, c, t, g, unknown or other
  modified_base (456)..(456): a, c, t, g, unknown or other
  modified_base (470)..(470): a, c, t, g, unknown or other
  modified_base (505)..(505): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtcgaccacaacatggactgggtccncaggctccgaggggagggctgggagtgggtcgcgtatacgaaggaacgctaaangttacagtacagatacgggcncgtcgtagtaggaaaaggtacggttcaccatctacgaaagagatgattacaaaagactcactgtatctagacaaatgaacngacctagaaaccgngacacgcgtatattagtgaggtaacaacaaaaggngtaggaagtggacggtgtagctagtagacc

SEQ ID NO: 361128 - DNA, 593 bp, Homo sapiens
  misc_feature: GZ8MTXP02FKPSW.21.4.A04.1.454.CMB.2.raw
  modified_base (216)..(216): a, c, t, g, unknown or other
  modified_base (279)..(279): a, c, t, g, unknown or other
  modified_base (284)..(284): a, c, t, g, unknown or other
  modified_base (288)..(288): a, c, t, g, unknown or other
  modified_base (301)..(301): a, c, t, g, unknown or other
  modified_base (351)..(351): a, c, t, g, unknown or other
  modified_base (356)..(356): a, c, t, g, unknown or other
  modified_base (491)..(491): a, c, t, g, unknown or other
  modified_base (534)..(534): a, c, t, g, unknown or other
  modified_base (548)..(548): a, c, t, g, unknown or other
tcagtcgtcgctcgcacgaccggtgctcgatttagagtagtgatcaggggagctctgagagcggagccccagccccagaattcccaggtgttttcatttggtaatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcacttcagtnaccanaacntggactgggtccncaggctccgaggggaggggctgggagtggggtcgcgtatacgaaggaacnctaanagttacagtacagagtacggcgcgtctggtaaggaaaaggtacgttcaacatactacgaagagtatgtaacttacaaaagtaactcaactgtaatcgagactaaatacgaaaccagtaccctaaaggaaaaccgngggaaccacgggtaccgtagttattaagttggtaaggttaaanaaacgtaaaagggnggtaacggtaagttagggtaggtacggtagtcgtacggtacgacg

SEQ ID NO: 361129 - DNA, 637 bp, Homo sapiens
  misc_feature: GZ8MTXP02JVNQY.21.4.A04.1.454.CMB.2.raw
  modified_base (351)..(351): a, c, t, g, unknown or other
  modified_base (356)..(356): a, c, t, g, unknown or other
  modified_base (369)..(369): a, c, t, g, unknown or other
  modified_base (438)..(438): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgctattcaccttcagtcgaccacaacatggactcgggtccgcaggcctccgaggggagggctggagtgggcgcgtatacaaggaanctaanagttacagttaanaggaataccgggcgacgtcgtagaacgaaagggtaacggtttccaaccctagtacctacgaaagggtanagtagtaactaaacaaacgtacctactaacgttagtaactcgtaagaaactaaaagacgaaaccgtacgaaccgtaaacggaaaaccggacggaaccgaccggttacgtagttaagttacggttaggtaacggaaacgaaacgtaaaaggtagggtaaggtaaggttcggggtagggtacggtacggcgttaggtaacg

SEQ ID NO: 361130 - DNA, 565 bp, Homo sapiens
  misc_feature: GZ8MTXP02HPZCC.21.4.A04.1.454.CMB.2.raw
  modified_base (179)..(179): a, c, t, g, unknown or other
  modified_base (305)..(305): a, c, t, g, unknown or other
  modified_base (363)..(363): a, c, t, g, unknown or other
  modified_base (399)..(399): a, c, t, g, unknown or other
  modified_base (478)..(478): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtntccagtgtgaggtgcagctgggtggagtcgtgggggagacttggtccagcctgggagggtccctgagactctcctgtgcagcctctgcattcaccttcagtgaccacaacagtggactggggtccnccaggcctaccgaggggaaggggctgggagtggggtcggaccgtataacgaaggaaanctaaacagttacagttacaggaatacggcgtccgtntggtagaaaacgggagttacaacctatctacaaagtagatagtataacaaaagaactacactagtatctagactaaaanagaacacgacaaacgaaaccgagacgacggtcgtagttatagtagtagaagaacgaaagagtaagagtggtggtgtacgtcgtagcg

SEQ ID NO: 361131 - DNA, 540 bp, Homo sapiens
  misc_feature: GZ8MTXP02HPR6D.21.4.A04.1.454.CMB.2.raw
  modified_base (302)..(302): a, c, t, g, unknown or other
  modified_base (354)..(354): a, c, t, g, unknown or other
  modified_base (376)..(376): a, c, t, g, unknown or other
  modified_base (380)..(380): a, c, t, g, unknown or other
  modified_base (409)..(409): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtccncaggctccgaggggagggctggagtgggcgcgtatacaaggaaagctaaacngttacagtacagaaatacggcncgtnaggtagaaaggagttcaccatcacaaagngaatgattacaaaagactcactgtatcagacaaatagaacaagactacgaaaaccgaacggaacgacggaccgtagtattattagtaggtagaacgaaaagaagtaaggagtagtggtaggtagcgtgtag

SEQ ID NO: 361132 - DNA, 680 bp, Homo sapiens
  misc_feature: GZ8MTXP02ITOQ7.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacgttggtccagcctgggagggtccctgagactctcctgtgcagcctctgctattcaccttcagtcgaccacaacatggactggggtcccgccgaggcctaccggaaggggaacggggcgtaggggaggtcggggtccgggtacccggtaaagttaaccggaaagggtaaaacgtaccgtaaaacgtaaggtttaacgaagttaaacagggtaaacgttaacccggggccgtaccggttccgtagggtaaaggggtaaaaaggggtacgggttaccaaacccgtattacctagaaaggagtatagtaacttaacgaaaacgtacttcgtaaacttggtaacttcgtaagactaaaagtcgaaacacggacctaaaggaaaaccggagaaccgacggtccgttagtattagtggtagtaacgaaacgaaaggtgtaaggagtggtacgggtgtacgtgtggtacg

SEQ ID NO: 361133 - DNA, 576 bp, Homo sapiens
  misc_feature: GZ8MTXP02JPOX4.21.4.A04.1.454.CMB.2.raw
  modified_base (203)..(203): a, c, t, g, unknown or other
  modified_base (275)..(275): a, c, t, g, unknown or other
  modified_base (298)..(298): a, c, t, g, unknown or other
  modified_base (371)..(371): a, c, t, g, unknown or other
  modified_base (390)..(390): a, c, t, g, unknown or other
  modified_base (411)..(411): a, c, t, g, unknown or other
  modified_base (423)..(423): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctaactacatagcctggtaccagcagaactccnggccaggcctcccaggttccctnatcctatgctcgggtccccacgagggcccacgtggaccacgtccccagaccaggttcagtggcaggtgggtcnggggacaggtacttcactntccatcattagcagactgganccgtgaaacgtnttacgactagttagtatttacgtgtactagctaagttagtagggtaaacttcaccgttcgtcggttacgttaccggaccgaaaggggaaccctaaagggtaagaaaacgtacggaaaaccgtaagtggtaggctaggaccaccgtatcttacg

SEQ ID NO: 361134 - DNA, 548 bp, Homo sapiens
  misc_feature: GZ8MTXP02J3IWG.21.4.A04.1.454.CMB.2.raw
  modified_base (201)..(201): a, c, t, g, unknown or other
  modified_base (290)..(290): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgcctccagggaaanagccacctctcctgcagctccagccagaatatccagagctactacatagcctggtaccagcagaagcctggccaggctcccaggttccnatctatcgctgggtccccagagggcccactggcaatccccagaccaggttcagtggcaggtcggggtctggggacaggacttcactctcatcattagcagactggacgcctagaagtacgtttcgactaggttgtaacttactgtacagactagtagtaggaagttctaccttctcggtcgtttacggaccgaaggggaacccaaaggtacgaaacgtacggaaaacgaacgtgtacggcgtacgaccacactcgtcg

SEQ ID NO: 361135 - DNA, 629 bp, Homo sapiens
  misc_feature: GZ8MTXP02GZ2Q5.21.4.A04.1.454.CMB.2.raw
  modified_base (200)..(200): a, c, t, g, unknown or other
  modified_base (296)..(296): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctccaggctcagaaaccacggagaaattgtgttgacgcagtctccaggcacctgtctttgtctccgaggggaaancgccaccctctcctgcagctccagccaagaatatccagagctaactacatacgcctaggtaccagcagaagcctggccaggcctcccgaggttccnatctagtcgcgtcgggtcccagacggcccagtcggcactccccgaagactacgggttcaggttcggacgtagggtcgggttcctggggaccaggtaccctttcgaccttctacactacattagacaggaccgtaggacgccgtagaagtactttcgactagtgttaattacgtgtacagctagtagtacggtaacgttctaccgttgtcgttccggttaccggaccgtaaacgggtaaaccgtaaaggggttaaacgaaaacgttaaccgggaaaaacgtaacggtcgggttacggacgttaccggaaccgtaacctaacgtttccgtttacg

SEQ ID NO: 361136 - DNA, 755 bp, Homo sapiens
  misc_feature: GZ8MTXP02HB302.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctggacgactctcctgtgcagcctctgctattccaccttcagtcgaacccacaacagtggacctcggggtcccgccgaggcctaccggaagggggaacggggcgtaggggacggtcggggtaccggccggttaaagttaaccgaaaaggggaaaacgtccgtaaaacgacgtttaacgaaggttaacagggtaaacgtaccggggcgtccgttacgtaggtaagggaaaacggggtacgttaccaaacccgtattacgtaacgaaaaggagtaagtaggtaaactttaacgaaaaacgtaccttacaacgttaggtacttacgagaacctaaaagtcgaaaaccacggtaaccctaaagggaaaaaccccggaggaacccgtaaccggggtacgttaggtttaaatttaacggttacgggtaaagggttaaacgaaaacgtaaaaaggggtcggttaaggggtaaagtttcgggggttaaggggtgggttaacgtcggtttacggtaaaccg

SEQ ID NO: 361137 - DNA, 568 bp, Homo sapiens
  misc_feature: GZ8MTXP02IZU6P.21.4.A04.1.454.CMB.2.raw
  modified_base (305)..(305): a, c, t, g, unknown or other
  modified_base (373)..(373): a, c, t, g, unknown or other
  modified_base (415)..(415): a, c, t, g, unknown or other
  modified_base (423)..(423): a, c, t, g, unknown or other
  modified_base (431)..(431): a, c, t, g, unknown or other
  modified_base (440)..(440): a, c, t, g, unknown or other
  modified_base (550)..(550): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacatggactggggtcccnccgaggcctccgaggggaggggctggagtggggtcgcgtatacaaggaagctaacagttacagtaacngaaatacgggcgacgtctgtagaaagggaagttcaaccatcncaaagagntgaattanaaaagactnaactgtatctagacaaaagtgaaaccagaccctaagaaaacccgaggaacgacggaccgttggtaatttagttggtaggtagaaaacaaaggagttggaattggtagggnggttacggcttaggtacg

SEQ ID NO: 361138 - DNA, 574 bp, Homo sapiens
  misc_feature: GZ8MTXP02JLUWX.21.4.A04.1.454.CMB.2.raw
  modified_base (302)..(302): a, c, t, g, unknown or other
  modified_base (473)..(473): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactgggtccnccaggctccgaggggagggctgggagtgggtcgccgtagttacgaaggaagctaaacaggttacagtacagaatacgggcgacgtctaggtagaaagggtaacggttcaaccatctacaaagagatgaattacaaaagactacacgttagtatcctagaccaaatgaaacngacctaaggaaaaccgaggaacgacggtaccgtagtattagtggtaggtaacgaacgaaaagtaggtaaggagttcggtagggtaggtagtcgtaggtacg

SEQ ID NO: 361139 - DNA, 549 bp, Homo sapiens
  misc_feature: GZ8MTXP02ICJ05.21.4.A04.1.454.CMB.2.raw
  modified_base (304)..(304): a, c, t, g, unknown or other
  modified_base (470)..(470): a, c, t, g, unknown or other
  modified_base (487)..(487): a, c, t, g, unknown or other
  modified_base (543)..(543): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctgggggagacttggtccagcctgggagggtccctgagactctcctgtgcagcctctgcattcaccttcagtgaccacaacatggactcggggtccnccaggcctccgaggggaaggggctgggagtggggcggaccgtatacaagggaaagctaacagttacagtacagaatacggcgcgtctggagaaaagggacgttcaccatctacaagagatgaattacaaaagtactacacttggtaatctagactaaaatgaaacngaccctagaaaacccgnggacacggtccgtagttatattggagtagaactaaagagtggaatggtgtagacgngtgacg

SEQ ID NO: 361140 - DNA, 871 bp, Homo sapiens
  misc_feature: GZ8MTXP02HGHWL.21.4.A04.1.454.CMB.2.raw
tcagtcgtcgctcgcacgaccggtgctcgatttagagtagtgatcaggggagctctgagagcggagccccagccccagaattcccaggtgtttcatttggtgatcagcactgaacacagaggactcaccatggagttgggctgagctgggttttccttgttgttatttacaaggtgtccagtgtgaggtgcagctggtggagtcgtgggggagacgttggtccagcctggaggtccctgagactctcctgtgcagcctctgcacttccaccttcagtcgaccaacaacagtcggacgtcggggtcccgcccgacggccgtacccggaaaggggaacggggtccgtaggggaggttcgggggtccgggtacccggttaaacgtttaaccggaaaaggggtaaaacggtaccttaaaaccgtaaggtttaaaccgaaacggttaaaccgaagggtaaacgttaaccggggaccgggtaccgttaccggtacgggttaaagggaaaaagggggttaaaccgggtttacccaaaaccccgttaagtttaccccgtaaacgtaaaaagggtaaggtaaactttaagggtaaaacttttaaaccgaaaaaaacgtaaacccttaaacccgtaaaccgtttaggtaaactttccgtaacggtaaacctaaaaagttacgaaaaccgtaaccggtaaccccgtaaaacggaaaaaacccccgggaggggaaaaccccgtaaacccggggtacccggtttaaaggtttaaacgtttaaacgttacggggttaaacggttaaagaaaaaccggtaaaaagggtaggtaaggtaaggttaggggttaacggggttaggttaaacggccgtttaagggtaacg

SEQ ID NO: 361141 - DNA, 579 bp, Homo sapiens
  misc_feature: GZ8MTXP02HX993.21.4.A04.1.454.CMB.2.raw
  modified_base (199)..(199): a, c, t, g, unknown or other
  modified_base (292)..(292): a, c, t, g, unknown or other
  modified_base (382)..(382): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtacccagcagaagcctggccaggcctcccaggttccctnatcctatgctgggtccccacgacggggcccacgtggcatccccagacaggttcagtgcaggtgggtctggggacaggtccttcactctanatcgattagcagactggagtcctgaagtatttcgcgagttgtattactgtcagctaagtagtaggtacgttctaccttcgtcgttcggtttaccggaccggtaaacggggtaccgtaaaagggttaaggaaaacgttaacggaaaaccgtagttaacgggtcggtacgttacggacctaccgtaacgttacgtttcg

SEQ ID NO: 361142 - DNA, 572 bp, Homo sapiens
  misc_feature: GZ8MTXP02G6CN1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtcccgccaggcctccgaggggaggggctggagtgggtcgcgtattacgaaggaagctaaacagttacagtacagaatacggcgcgtctgtagaaaggtagttcaaccatctacaaagagatgaattacaaaagactacgacttgtatcagacaaaatcgaaacacgacctaaggaaaacccgagggaaccgaaccggtccgtagttattagttggtaggttagaaactaaaaggtagtaaggtaagtcggttagggtaggtagtcgtaggtacg

SEQ ID NO: 361143 - DNA, 560 bp, Homo sapiens
  misc_feature: GZ8MTXP02HSGGF.21.4.A04.1.454.CMB.2.raw
  modified_base (202)..(202): a, c, t, g, unknown or other
  modified_base (216)..(216): a, c, t, g, unknown or other
  modified_base (241)..(241): a, c, t, g, unknown or other
  modified_base (245)..(245): a, c, t, g, unknown or other
  modified_base (247)..(247): a, c, t, g, unknown or other
  modified_base (331)..(331): a, c, t, g, unknown or other
  modified_base (361)..(361): a, c, t, g, unknown or other
  modified_base (369)..(369): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctccngcagctccagccagaatatccaganctananatagctgacagcagaagcctgcagctccacgtctcatctatgctcggtccacgacggacactgcactaccacacacgtcagtgngagtggtcgtgggacgagacttctactctnatatatancagacgtagacgcgtagtaagtaagttacgtactagtagttaattacttacgtacgagacgtagtaagtaggtaagttactacctactcgttcggttcggtacgaaacgggaaacgaaaggtaaaacgtaaaacgtaaacgtaaaacgtaaaacgtaagtacggtacgtacgtacgacctaactacgtacg

SEQ ID NO: 361144 - DNA, 564 bp, Homo sapiens
  misc_feature: GZ8MTXP02IU1KG.21.4.A04.1.454.CMB.2.raw
  modified_base (276)..(276): a, c, t, g, unknown or other
  modified_base (303)..(303): a, c, t, g, unknown or other
  modified_base (349)..(349): a, c, t, g, unknown or other
  modified_base (379)..(379): a, c, t, g, unknown or other
  modified_base (416)..(416): a, c, t, g, unknown or other
  modified_base (436)..(436): a, c, t, g, unknown or other
  modified_base (482)..(482): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttnagtcaccacaacatggactggggtccncaggctcgaggggagggctggagtgggtcgccgtatacgaaggaanctaaacagttacagtacagaactacgggcngtctggtagaaaaggtagttcaaccatctacaaaganatgaattacaaaagacttanacttagtactcagacaaaatcgaaacaggtacctaaggaaaaccgngggaacacggtccgtagtattagtcgtaggtaacaacgaaaaggagtggaagttgggtagggttaggtacgcgttaggtacg

SEQ ID NO: 361145 - DNA, 548 bp, Homo sapiens
  misc_feature: GZ8MTXP02HQ2JF.21.4.A04.1.454.CMB.2.raw
  modified_base (200)..(200): a, c, t, g, unknown or other
  modified_base (290)..(290): a, c, t, g, unknown or other
  modified_base (375)..(375): a, c, t, g, unknown or other
  modified_base (405)..(405): a, c, t, g, unknown or other
  modified_base (411)..(411): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatatccagagctactacatagcctggtaccagcagagcctggccaggcctcccaggttccnatctatgctcgggtccccagagggcccacgtggccatccccagacaggttcagtggcaggtgggtctggggacagtcttcactcncatcattagcagactggagcctagaacgtntttcgntagttgttattacttgtctagctagtagtggtaacgttcaccttcgtgttccggttacggaccggtaaagggaccaaagggttaagaaacgtagaaaacgtacgtggtacggtactacggacaccgtacgttcttcg

SEQ ID NO: 361146 - DNA, 702 bp, Homo sapiens
  misc_feature: GZ8MTXP02F619C.21.4.A04.1.454.CMB.2.raw
  modified_base (415)..(415): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttatttacaaggtgtccagtgtgaggtgcagctggtggagtcgtgggggagacttggtccagccgtgggagggtccctgagactctcctgtgcagcctctgctattccaccttcagtcgaacccacaacatggactggggtcccgccgaggcctaccggaggggaacggggctggggaggttggggtccggaccgtaatacgaaaggaaacgctaaacgagttacagtacaggaaactacgggcgcgttcgnggtaggaaaagggtaacggttccaaccgtatctacaaaggagtatagaattaacgaaaaacgtacctacgtaacgttgttaaacttctacggaaacctaaaagtacggaaaaccgaacggtaccccgttaaaagggaaaaaacccccggtaggggaaccccgaaaccggggttacccggttaagttaaagttttaacggttaggggttagggtaaaacgaaaacgaaaaaggtaggttaaggggaagttggggtaggggttaccggtaaggtccgttagggtaaccg

SEQ ID NO: 361147 - DNA, 614 bp, Homo sapiens
  misc_feature: GZ8MTXP02HO14S.21.4.A04.1.454.CMB.2.raw
  modified_base (218)..(218): a, c, t, g, unknown or other
  modified_base (306)..(306): a, c, t, g, unknown or other
  modified_base (330)..(330): a, c, t, g, unknown or other
  modified_base (355)..(355): a, c, t, g, unknown or other
  modified_base (374)..(374): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctgggtggagtcgtggggganacttggtccagcctggagggtccctgagactctcctgtgcagcctctgcattcaccttcagtgaccacaacatggactggggtccccncgaggctacggagggaggcgtggnggtgggcgtacgtatacgaaggaanactaacgtagttacagtanagaacgtacggcgtcgtagtaggtaagaaagggtacgttaccaactatacagaaagagtatagaacttaacgaaaagtaactactacttagttacttacgtagtaacaaagtaacgaaacgaacgaaccgtaacgaaaccggaaacggaacgaacggtaccgtacgttaagttagttagttacggtaacgtaaacgaaaagaaggtaaggtagtaggtaggtaggtaggtacgtagtacg

SEQ ID NO: 361148 - DNA, 564 bp, Homo sapiens
  misc_feature: GZ8MTXP02J2SLW.21.4.A04.1.454.CMB.2.raw
  modified_base (302)..(302): a, c, t, g, unknown or other
  modified_base (348)..(348): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctggagggtccctgagactctcctgtgcagcctctgcattcaccttcagtgaccacaacatggactgggtcccnccaggctccgagggagggctggagtgggtcgcgtatacgaaggaanctaacagttacagtacagaatacggcgcgtactggtaggaaagggtacgttcaaccattcacgaagagatgaattacaaagtactcgactgatcgtagacaaaatcgaaacacgtacccgtaaggaaaacccggaggaacccacgggtccttaaggtaattgttagttagggacaaacgaaaaggtgtgggaatggtacgggtagtgacgtgtacg

SEQ ID NO: 361149 - DNA, 686 bp, Homo sapiens
  misc_feature: GZ8MTXP02F0VT6.21.4.A04.1.454.CMB.2.raw
  modified_base (313)..(313): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttatttacaaggtgtccagtgtgaggtgcagctggtggagtcgtgggggagtacttggtccagccgtgggacgggtccctgagactctcctgtgcagcctctgctattcaccttcagtcgaacccaacaacagtgggactcggggtcccnccgaggcctccggaggggaacggggcgtggggagggttcggggtccggaccgttaagttaacgaaagggaaacgcctaaaacgtagttaacaagttaacaggtaaactaccggggcgtaccgttcgtaggtaaggaaaaggggtaacggttccaacccgtatcctaagaaaagtacgagttagaacttaacgaaaaacgtaacttacaaccgttagttaacttctagaaactaaaatacgaaacacgtaacccgtaaaggaaaaacccgagggaaccgtaaccgggtccgttaagttagttagttacgggtacggtaaacgaaaacgaaaaggtaggtaaggtagtgggtacggtggtagacgttaggtaacg

SEQ ID NO: 361150 - DNA, 591 bp, Homo sapiens
  misc_feature: GZ8MTXP02F6JA5.21.4.A04.1.454.CMB.2.raw
  modified_base (307)..(307): a, c, t, g, unknown or other
  modified_base (356)..(356): a, c, t, g, unknown or other
  modified_base (417)..(417): a, c, t, g, unknown or other
  modified_base (492)..(492): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatcggactggggtcccncgaggctccgaggggagggctgggagtgggcgccgtatacgaaaggaanctaaacagttacagttacagaatacggcgacgtctagtaggaaaggtagtcaccgatctanaagagatagaattacaaaagactacgactgtatactgaacctaaaatcgaaacacggtacctaaggaaaaccggnggaacgaaccgggtacctaggttaattacgtttaggacgggttaagaaaacgaaaagtaggtaaggtaagtgggttagggtacggtagcgttaggtacg

SEQ ID NO: 361151 - DNA, 610 bp, Homo sapiens
  misc_feature: GZ8MTXP02G4ASS.21.4.A04.1.454.CMB.2.raw
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgttcagtgtgaggtgcagctgggtggagtcgtgggggagacttggtccagccgtgggacgggtccctgagactctcctgtgcagcctctgcattcaccttcagtcgaccacaacatggactgggtcccgccaggcctaccgaggggaagggctgggaggtggggtcggaccgtataacgaaggaacgtctaacagttacagtacaagagtcggcgcgtctgtagaaaggtaggtacacagtctacgaagagatgaattacaaaagaactacactagtactctagactaaagtacgaaacaacgaccgtaaacgaaaaccggacggaacgaaccggtcccggtaagtaacgtttagttacggtaaggtaaagaaacgtaaaaaggtggtaaggtaagtaggtacggggtaggtagtacgttacggtagtaaccg

SEQ ID NO: 361152 - DNA, 617 bp, Homo sapiens
  misc_feature: GZ8MTXP02GZX3A.21.4.A04.1.454.CMB.2.raw
  modified_base (311)..(311): a, c, t, g, unknown or other
  modified_base (402)..(402): a, c, t, g, unknown or other
  modified_base (438)..(438): a, c, t, g, unknown or other
  modified_base (490)..(490): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggacgggtccctgagactctcctgtgcagcctctgcattccaccttcagtgaacccacaacatggactggggtcccnccaggcctccgaggggacggggctggaggtcgggtcggccgtaatacgaaaggaagctaaacagttaacagtacagaactacggcgtcgtntggtagaaaagggtagttcaaccagtcacaaagganatagtattaacaaaagtactacactagtactcgtagactaaaatcgaaaacncgaaccgtaaacggaaaaccgagggaacacgggtaccgttagttaaatttacgttaggtacggttaaagaaactaaaagggtagttgggaaagttgggtaagggtggttaaacgcggttaggtaacg

SEQ ID NO: 361153 - DNA, 593 bp, Homo sapiens
  misc_feature: GZ8MTXP02I7ED3.21.4.A04.1.454.CMB.2.raw
  modified_base (426)..(426): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggaatttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacatggactggggtcccgcaggcctccgaggggaaggggctgggagtgggtcgccgtattacaaggaaagctaacagttacaagtacagaaatacgggcgcgtctaggtaggaaaagggtagttccaaccgatcctanaaagagtatagaattacaaaagacctacaacttgtaatctagactaaaatcgaaacagaccgtaaaggaaaacccgagggaaccacgggtaccgttagttaatttagttggtaacggtaagaaacaaaaggtggtaaggattagggtaggtcggtagtcgtagtacg

SEQ ID NO: 361154 - DNA, 576 bp, Homo sapiens
  misc_feature: GZ8MTXP02HQ1U8.21.4.A04.1.454.CMB.2.raw
  modified_base (358)..(358): a, c, t, g, unknown or other
  modified_base (476)..(476): a, c, t, g, unknown or other
  modified_base (495)..(495): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggcctccgaggggaagggctgggaggtgggtcgccgtatacgaaggaagctaanagttacagtacagaagtacggcgcgtcgtagtagaaaagggagttccaaccgattccagaaagagtatagtaattaccgaaaagtacctcaacttagtactctagacaaaatcgaaanacgacctaaggaaaaccgnggaacacgggtcctagttatagttgtaaggtacgaaaacgaaaggtgtaaggagttggtgggtacggttagcgttagtacg

SEQ ID NO: 361155 - DNA, 563 bp, Homo sapiens
  misc_feature: GZ8MTXP02I0822.21.4.A04.1.454.CMB.2.raw
  modified_base (285)..(285): a, c, t, g, unknown or other
  modified_base (302)..(302): a, c, t, g, unknown or other
  modified_base (353)..(353): a, c, t, g, unknown or other
  modified_base (378)..(378): a, c, t, g, unknown or other
  modified_base (555)..(555): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctgggggagacttggtccagcctgggagggtccctgagactctcctgtgcagcctctgcattcaccttcagtgaccanaacatggactgggtccncaggctcgagggagggctggagtgggtcgtcgtatacaaggaaagctaaanagttacagtaacaggaatacgggcncgtctgtagaaagggtaaggttcaaccatctacaaagagatgaattacaaaagacttacaacttgtaacttctagacaaaagtgaaacaggaccctaagaaaacccgaggaccacgggccgtagtacttattggtaggtaagaaacgtaaaagaggttaaggaatggtaggtggtancgttgtag

SEQ ID NO: 361156 - DNA, 626 bp, Homo sapiens
  misc_feature: GZ8MTXP02GE1XG.21.4.A04.1.454.CMB.2.raw
  modified_base (264)..(264): a, c, t, g, unknown or other
  modified_base (529)..(529): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctggagggtccctgagactctcctgtgcagcctcngcattcaccttcagtcgacccacaacagtggactggggtcccgccgaggcctccgaggggaggggctgggaggtggggtcggccgtagttacgaaggaaagctaaacagttaacagtaacagaaacgtacggcgtcgtctggtaagaaaagggtaggttccaaccctatacctacgaaaagtacgatagaacttaacaaaagaccttacgaacttagtaactctagaactaaaatcgaaacagacccgtaaacggaaaacccggnggaaaccgtacgggaccgttaggttactttagttggtaggtaacgaaacgaaaaggtggtaaggtagtacggggtaggttaggtacgtcgtagtacg

SEQ ID NO: 361157 - DNA, 589 bp, Homo sapiens
  misc_feature: GZ8MTXP02FZDFZ.21.4.A04.1.454.CMB.2.raw
  modified_base (351)..(351): a, c, t, g, unknown or other
  modified_base (357)..(357): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggatacttggtccagcctggagggtccctgagactctcctgtgcagcctctgcattcaccttcagtcgaccacaacatggactgggtccgcaggctccgaggggagggctggaggtgggtcgcgtaatacgaaggaaanctaaanagttacagtacagaatacggcgcgtctagtagaaaggtacgttcaaccatctagaaagagatagaattacaaaaagactacgaacttgtaactcgtagaacaaaatgaaactacgaccgtaaaggaaaacccgaaggaaccgacgggtaccgtagttaatttagttgggtaagtaacgaaacgaaaaggtaggtaaggtaattgggtacgggtaggtaagcgttaggtaacg

SEQ ID NO: 361158 - DNA, 561 bp, Homo sapiens
  misc_feature: GZ8MTXP02F8SD8.21.4.A04.1.454.CMB.2.raw
  modified_base (215)..(215): a, c, t, g, unknown or other
  modified_base (302)..(302): a, c, t, g, unknown or other
  modified_base (351)..(351): a, c, t, g, unknown or other
  modified_base (442)..(442): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtgaccacaacatggactggggtcccnccaggctccgaggggaagggctgggagtgggtcgcgtatacaaggaaanctaaacagttacagtacagaaatcggcgcgtctaggtagaaaagggtaaggttccaaccagtctacaaagagatgaattacaaaagactanactgtatctagacaaatgaaacagcctaagaaaaccgagacgacggtcgtagtattagtgtaggtaagaaacaaaaggagtaaggaattgggtagggtacggttaacggcgtacgtacg

SEQ ID NO: 361159 - DNA, 613 bp, Homo sapiens
  misc_feature: GZ8MTXP02GYMX6.21.4.A04.1.454.CMB.2.raw
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatggactggggtcccnccgaggcctccgaggggaggggctgggaggtggggtcggccgtattacgaaggaaagctaaacagttacagtacagaatacgggcgcgtctggtagaaagggaagttcaaccatctacaaagagatgaattacaaaagactacacttgtaatctagacaaatcgaaacacgacctaaacggaaaaacccggaggaaaccgtacggggtacccgttagttaaacgtttacgttagggtaagggtaacgaaaacgtaaaaggaggtaaggggaaattaggggtcggggtaggtacgtcggttaggtacgg

SEQ ID NO: 361160 - DNA, 535 bp, Homo sapiens
  misc_feature: GZ8MTXP02HPMTL.21.4.A04.1.454.CMB.2.raw
  modified_base (302)..(302): a, c, t, g, unknown or other
  modified_base (351)..(351): a, c, t, g, unknown or other
  modified_base (471)..(471): a, c, t, g, unknown or other
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcagctgggtggagtctgggggagacttggtccagcctggagggtccctgagactctcctgtgcagcctctgcattcaccttcagtgaccacaacatggactggggtcccncaggctcgaggggaggggctggagtgggtcgccgtattacgaaggaaanctaacagttacagttacagaatacggcgcgtctgtaggaaaaggagttcaccatctacaaagagatgaatacaaaagaactcaactgtatctgacaaatgaacagaccctagaaaaccgnggacacggctagtattactggtagtagaaacaaaagtaggtgataggtggtacgtagcttgacg

SEQ ID NO: 361161 - DNA, 578 bp, Homo sapiens
  misc_feature: GZ8MTXP02FRA73.21.4.A04.1.454.CMB.2.raw
  modified_base (310)..(310): a, c, t, g, unknown or other
  modified_base (405)..(405): a, c, t, g, unknown or other
  modified_base (432)..(432): a, c, t, g, unknown or other
  modified_base (549)..(549): a, c, t, g, unknown or other
  modified_base (565)..(565): a, c, t, g, unknown or other
  modified_base (571)..(571): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacgttgggtccaggcccgtgggacggggtccctgagactctcctgtgcagcctctgcattcaccttcagtcgaccacaacatggactgggtccnccgaggctccgaggggaaggggctgggaggtcggggtcggacgtaagttacgaaggaaacgctaaacgagttacaagtacagaatacggcgcgtntagtagaaagggagttcaaccatctanaaagagatagaattacaaaagactacaactagtatctagacaaaatcgaaacagcctaaaggaaaaccgaggtaccaacggcgttagtattagtggaggtaacgaaacaaaggtagnggtaactggttagggngtacgngtagacg

SEQ ID NO: 361162 - DNA, 688 bp, Homo sapiens
  misc_feature: GZ8MTXP02I50MY.21.4.A04.1.454.CMB.2.raw
  modified_base (314)..(314): a, c, t, g, unknown or other
  modified_base (345)..(345): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagtacgttggtccagccgtgggacgggtccctgagacctctcctggtgcagcctctgctattccaccttcagtcgaccacaacagtggacgtgggtccnccgaggcctaccggaggggaacggggtccgngggtaggtcggggtccggaccgttaagttaacgaaaaggggtaaacgacctaaacgtaagttacgaagtaacgagtaaacgtacggacgtcgtctaggtaacgggaaaaggtaacgttccaaaccgtatccgtaacgaaaaggtagaaagttacgtaaagtaacgtaaacgtaaaccttacgtaactacgtagtacgaattagaaccaaacgtaaccgtaacgaaaaccggaaccggtaacgtaaaccggaaccggtaacgtaacgtacgttacgtacggttaaggtacgtaacggtaaggtaggaaagtaggtaggtaggtaggtacggtacggtaggtacg

SEQ ID NO: 361163 - DNA, 620 bp, Homo sapiens
  misc_feature: GZ8MTXP02FN31H.21.4.A04.1.454.CMB.2.raw
  modified_base (309)..(309): a, c, t, g, unknown or other
  modified_base (371)..(371): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgagactctcctgtgcagcctctgcattccaccttcagtcgaccacaacatggactcggggtcccnccgaggcctccggaggggaacggggctggggaggtcggggtcggccgtattacgaaggaaanctaaacgagttacagtacagaactacggcgcgtctaggtagaaagggtaacggttccaaccgtatctaacaaaggagattagaattacgaaaaacgtacctacaacttgtactcctagaccaaaatgaaacacgacctaaacggaaaacccgaggaccgaacgggtccttagtaacttacgttaggtacggtaagaaacgaaaaggtaggtaaggagttcgggtagggtaggtaacgtcgtaggtaacg

SEQ ID NO: 361164 - DNA, 586 bp, Homo sapiens
  misc_feature: GZ8MTXP02HPOD7.21.4.A04.1.454.CMB.2.raw
  modified_base (290)..(290): a, c, t, g, unknown or other
  modified_base (416)..(416): a, c, t, g, unknown or other
  modified_base (474)..(474): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgtgttttccttgttgttattttacaaggtgtccagtgtgaggtgcagctggtggagtcgtgggggagacttggtccagcctgggagggtccctgagactctcctgtgcagcctctgcattcaccttcagtcgaccacaacntggactcgggtcccgccgaggcctccgaggggaggggctggaggtggggtcgcgtataccgaaggaagctaacagttacagtacagaatacggcgcgtctagtagaaaggtagttccactatctanaagagatgatacaaagactcatgtatctagacaatagaacacgctaaggaaaacccgnggaaccgacggtaccgttagttaaactttaagtttcgggtaaggtaagtaaaaccgaaaaaggtaaggtaggtaagttagggttacggggtaggtttaaggcctttaagggg

SEQ ID NO: 361165 - DNA, 581 bp, Homo sapiens
  misc_feature: GZ8MTXP02FLURX.21.4.A04.1.454.CMB.2.raw
  modified_base (479)..(479): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatggactgggtcccgccgaggcctccgaggggaaggggctgggaggtgggtcggcgtattacgaaggaaagctaaacagttacagtacagaatacgggcgacgtctaggtagaaaagggtagttccaaccgatctacaaagagatagaattacaaaagtactacacttagtatctagaacaaatcgaaanacgacctaacggaaaaccgaggaacgaccggtacgtagtacttagttggtaaggtagaaacgaaaaggagtaaggattaggtaggtggtagcgttagtacgg

SEQ ID NO: 361166 - DNA, 584 bp, Homo sapiens
  misc_feature: GZ8MTXP02HYZM5.21.4.A04.1.454.CMB.2.raw
  modified_base (270)..(270): a, c, t, g, unknown or other
  modified_base (381)..(381): a, c, t, g, unknown or other
  modified_base (401)..(401): a, c, t, g, unknown or other
  modified_base (414)..(414): a, c, t, g, unknown or other
  modified_base (419)..(419): a, c, t, g, unknown or other
  modified_base (442)..(442): a, c, t, g, unknown or other
  modified_base (446)..(446): a, c, t, g, unknown or other
  modified_base (448)..(448): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctgggtggagtcgtgggggagacttggtccagccgtgggacgggtcccctgacgactctcctgtgcagccctntgcattcaccttcagtcgaccacaacagtggaccgtcggggtcccgccgaggcctccggaaggggaaggggctgggaggtcggggtcggaccgtattaacgaagggaaacnctaaacgagttacagtaacngtaaatacgggcncgtcngtagaaagggtagtcaccatcanaganangatacaaacgactcactatacttcagacaaagagaacacgaccgaacgaaacggaacgaacgacggaccgtagttagttagttagtacggtacgaacgaaaagaagtaaggagtaggtggtggtacgtcgtgtacg

SEQ ID NO: 361167 - DNA, 547 bp, Homo sapiens
  misc_feature: GZ8MTXP02GU78K.21.4.A04.1.454.CMB.2.raw
  modified_base (302)..(302): a, c, t, g, unknown or other
  modified_base (344)..(344): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccncaggctcgagggagggctggagtgggcgcgtatacaaggaanctaacagttacagtacagaatacggcgcgtctaggtagaaagggtagttcaacctatctacaaagagatagaattacaaaagactacaactgtatctagacaaaatcgaaacagacctaaggaaaaccgaggacacgggtctagtattagtggagtacgaaactaaaagagtaagggattgggtcggtaggtagcttaggacg

SEQ ID NO: 361168 - DNA, 542 bp, Homo sapiens
  misc_feature: GZ8MTXP02I524A.21.4.A04.1.454.CMB.2.raw
  modified_base (347)..(347): a, c, t, g, unknown or other
  modified_base (508)..(508): a, c, t, g, unknown or other
  modified_base (517)..(517): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttcctgtgttatttacaagtgtcagtgtgaggtgcagctggtggagtcgtgggggagacttggtccagcctgggagggtcccctgagactctcctgtgcagcctctgcattcaccttcagtgaccacaacatggactggggtccgccaggctccgaggggagggctggagtgggtcgccgtatacgaaggaanctaaacagttacagtacagaatacgggcgcgtctaggtagaaaggtagttccaaccgtatctacaaagacgattagaattacaaaagacctacaacttgtatctagactaaaatgaaactgacctaggaaaaccgaggacacggcgtgtattgtagagtanaacgaaagngtgagtgtcggagtagcgtagtacg

SEQ ID NO: 361169 - DNA, 653 bp, Homo sapiens
  misc_feature: GZ8MTXP02JG0YZ.21.4.A04.1.454.CMB.2.raw
  modified_base (263)..(263): a, c, t, g, unknown or other
  modified_base (463)..(463): a, c, t, g, unknown or other
  modified_base (616)..(616): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacgttggtccagcctgggagggtccctgagactctcctgtgcagcctntgcattccaccttcagtcgaccacaacagtggactcggggtcccgccgaggcctaccggaaggggaaggggccgtaggggagggttcggggtccggaccgtaagttaacgaaaggggaaacgactaaacaaggttacagtaacaggaaatacgggcgcgtcgtaggtagaaaagggtaacggttccaaccgtatccgtanaaaggataagtggtaacttaacaaaagtaacctacaacttgtaatacctaggaacaaaagtcgaaaacacggtacccgtaaagaaaacccggaggaaccgaccgggtaccttaggtaattaaagttggtacggttaaacgaaaacggaaaagnggtaaggtagtacggtagggtaggtagacgtgtaacg

SEQ ID NO: 361170 - DNA, 738 bp, Homo sapiens
  misc_feature: GZ8MTXP02HRAKF.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacttggtccagccgtggacgggtccctgagtactctcctgtgcagcctcgtgcacttcaccttcagtcgaccacaacagtggacctggggtcccgcgaggcctaccggaggggaggggcgtgggaggtggggccgtaccgtattaacgaaggaaagctaaacgagttacagtaacagaaatacggcgcgtcgtaggagtaaaacgggagttaccgaactagttcccaagaaagtagtaagtaggtaacttaaccaaaaggtaaaccttaccgtaaaccttaggtttaacttaccgttaaggaaccttaaaaacgtaacggaaaccgtaaaccggtaaacccggtaaacgggaaaaacccgggtaacgggaaacccggtaaccgggttaaccggttaaggtttaaacgttaacggtttaacgggttaaacgggtaaacgaaaacggtaaaagggtagggttaaggggttaacggttaacggggttaggggttaaggttaccggttacggtttacggtaaccg

SEQ ID NO: 361171 - DNA, 587 bp, Homo sapiens
  misc_feature: GZ8MTXP02F314Q.21.4.A04.1.454.CMB.2.raw
  modified_base (360)..(360): a, c, t, g, unknown or other
  modified_base (477)..(477): a, c, t, g, unknown or other
  modified_base (494)..(494): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctggggttttccttgttgttattttacaaggtgtccagtgtgaggtgcagctggtggagtcgtgggggagacttggtccagccgtgggagggtccctgagactctcctgtgcagcctctgcattcaccttcagtgacccacaacatggactgggtccgccgaggcctccgaggggagggctggaggtggtcggcgtatacgaaggaagctaanagttacagtacagaatacggcgcgtctgtagaaagggtagttcaaccgtatctacgaaagtacgataggaacttacgaaaagtactacgaacttggtactctagacaaatagaaacngacctaaggaaaaccgnggactacggccgtagttacttaagttggtacggtaagaaacgtaaaaggtaggtaaggtaagttagggtacgggtaggtagacgttggtaacg

SEQ ID NO: 361172 - DNA, 592 bp, Homo sapiens
  misc_feature: GZ8MTXP02I8NCC.21.4.A04.1.454.CMB.2.raw
  modified_base (373)..(373): a, c, t, g, unknown or other
  modified_base (445)..(445): a, c, t, g, unknown or other
  modified_base (501)..(501): a, c, t, g, unknown or other
  modified_base (563)..(563): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccaggccgtgggagggtccctgagactctcctgtgcagcctctgcattcaccttcagtcgacccacaacatgggactggggtcccgccgaggcctccgaggggaaggggctgggaggtggggtcggccgtaattacaaaggaagctaanagttacagtaacaggaatacggcgtacgtctaggtagaaagggtaaggttccaaccctatctacgaaagganatagaacttacgaaaagtactcacgttagtatccgtagaccaaaagtcgaaaaccngaccctaaaggaaaacccggaggaccacggtcgtagtattagtgacggtaagaacgaaaagngtaaggattcgggtggtagagctggtacg

SEQ ID NO: 361173 - DNA, 543 bp, Homo sapiens
  misc_feature: GZ8MTXP02H0Z7S.21.4.A04.1.454.CMB.2.raw
  modified_base (265)..(265): a, c, t, g, unknown or other
  modified_base (305)..(305): a, c, t, g, unknown or other
  modified_base (357)..(357): a, c, t, g, unknown or other
  modified_base (374)..(374): a, c, t, g, unknown or other
  modified_base (478)..(478): a, c, t, g, unknown or other
  modified_base (509)..(509): a, c, t, g, unknown or other
  modified_base (515)..(515): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgagactctcctgtgcagcctntgcattcaccttcagtgaccacaacatggactggggtccnccgaggctccgaggggaagggctgggagtgggtcgccgtattacgaaggaanctaacagttacagtacngaaatacggcgcgtctgagaaagggagttcaaccgatctacaagagatgaattacaaaagactacactagtatctagacaaatgaacagacctaagaaaaccgngtacaacggctagtattatggtagtacgaanaaaagnggtaagagtaggtggacgtagcgtgtag

SEQ ID NO: 361174 - DNA, 616 bp, Homo sapiens
  misc_feature: GZ8MTXP02IZBRE.21.4.A04.1.454.CMB.2.raw
  modified_base (215)..(215): a, c, t, g, unknown or other
  modified_base (284)..(284): a, c, t, g, unknown or other
  modified_base (301)..(301): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtgacccanaacatggactgggtccncaggctcgagggagggctggagtgggtcgccgtagtacaaggaagctaaacagttacagtacagaatacgggcgcgtcgtaggtagaaaagggaacgggttcaaccgtatactacgaaagaagatagtaattacaaaagactacaacttgtaactctagacaaaatcgaaacagtaccgtaaggaaaaacccgagggaaccgaacgggtaccggttagttaaacgtttagtttaggtagggttaaagaaaaccgtaaaaaggtaggtaagggtaaagttaggggttggggtacgggtaagtccgttaggtaacgg

SEQ ID NO: 361175 - DNA, 589 bp, Homo sapiens
  misc_feature: GZ8MTXP02IQ0PC.21.4.A04.1.454.CMB.2.raw
  modified_base (301)..(301): a, c, t, g, unknown or other
  modified_base (482)..(482): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactgggtccncaggctcgagggagggctggagtgggcgccgtatacaaggaagctaacagttacagtacagaatacgcgcgtctagtagaaagggagttcaaccagtctacaaagagatgaattacgaaaagtaactcaacttgtaattccagacaaaagtacgaaacagaccctaacggaaaaacccggnggaaacccgaacgggtacccgttaggttaaactttaacgttggtaaggtaacgaaaacgaaaaaggtggttaaggagttaggtacgggtagtacggcttaggtaacg

SEQ ID NO: 361176 - DNA, 762 bp, Homo sapiens
  misc_feature: GZ8MTXP02HNDXV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctgggtggagtcgtgggggagacgttggtccagcctggagggtccctgagacctctcctgtgcagcctctgctattccaccttcagtcgaccaacaacataggacgtcggggtcccgccagggcctaccggaggggaacggggcgtaggggaggttcggggtccggacccgttaagttaaccgaaagggaaaacgtccgtaaactaacggtttaacaaggttaacaggtaaacgtaacgggcggtacgttaccgtaggtaacgggaaaagggtaaacggtttaccaaccgtaataccctacgaaaggaagtattaggaaactttaacgaaaaagtaaacccttacgtaaacctttaggttaaactttccgtaggaacctaaaaagttacggaaaacctacggaaccctaaacgggaaaaaaccccgggagggaaacccgaacccggggtacccgtttaggttaaagtttaacggtttagggtaaggggttaaacgaaacgtaaaaaagggtagggttaagggtaagttaggggttagggtacggtaaggtccggtttaagtaacgg

SEQ ID NO: 361177 - DNA, 588 bp, Homo sapiens
  misc_feature: GZ8MTXP02J3FX9.21.4.A04.1.454.CMB.2.raw
  modified_base (308)..(308): a, c, t, g, unknown or other
  modified_base (390)..(390): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccagcccgtgggagggtccctgacgactctcctgtgcagcctctgcattcaccttcagtcgaccacaacatggactggggtccnccgaggctccgaggggagggctgggagtgggtcggaccgtataacgaaggaaacgctaacgagttacagtacagaatacggngcgtctgtacgaaagggagttaccaccagtctacgaagagtatgaattacgaaagtactcatgatcgtagacaaaagtcgaaacgaagacccgtaaggaaaaccggaggaaccgtaccggccgttagttattaggtaggtagggtaacaaacgtaaaaggtggtaaggtaacgtggtagggtcgtagtcgtagtacgg

SEQ ID NO: 361178 - DNA, 557 bp, Homo sapiens
  misc_feature: GZ8MTXP02INVI2.21.4.A04.1.454.CMB.2.raw
  modified_base (302)..(302): a, c, t, g, unknown or other
  modified_base (410)..(410): a, c, t, g, unknown or other
  modified_base (420)..(420): a, c, t, g, unknown or other
  modified_base (484)..(484): a, c, t, g, unknown or other
  modified_base (521)..(521): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctggagggtccctgagactctcctgtgcagcctctgcattcaccttcagtgaccacaacatggactgggtccnccaggctcgaggggagggctggagtgggtcgcgtatacgaaaggaaacgctaaacgagttacaaggttacaggaatacggcgcgtctgtagaaagggagttcaaccgntctacaaganatgaattacaaaagaactcaacttgtactctagacaaaatgaaactaggacctaagaaaaccgngaacgacggtctagtattagtgtagtagaacaaaggngtaaggtatacggtggtaggtacgtgttacggtacg

SEQ ID NO: 361179 - DNA, 795 bp, Homo sapiens
  misc_feature: GZ8MTXP02FXBGO.21.4.A04.1.454.CMB.2.raw
  modified_base (276)..(276): a, c, t, g, unknown or other
  modified_base (328)..(328): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcggtgggggagtacgttcggtccgagtccgtgggacgggtccctgacgactcctcctgtcgcacgcctntgctacttccaccttcagtcgaacccaacaacagtcggacgtcggggtcccnccgaggtcctaccggaagggggaacggggtccgtaggggaggggttcggggtccggtaccgttaaagttaacggaaaacggggtaaaacgtacctaaaacgtaacggtttaaacaacggttaaaccaggggtaaaaccgttaaccgggggccggttaccggttaccgttaaggggttaaacggggaaaaaacggggttaacggggtttacccaaaacccggttattacccgttaacggaaaaggaagtattaaagggtaactttaaaccgaaaaaacggttacctaccggtaaaccttaggttaacttcgttaacggaaaccaaaagttccgaaaacgtacgaccgttaaacggaaaacccggaggaacccggacggtaccgttagtttaatttaggttaggtaacggtaaacgaaaacgaaaaggtaggtaaggaagttggttagggtacgtagtcgtagtaaccg

SEQ ID NO: 361180 - DNA, 543 bp, Homo sapiens
  misc_feature: GZ8MTXP02J27U4.21.4.A04.1.454.CMB.2.raw
  modified_base (215)..(215): a, c, t, g, unknown or other
  modified_base (303)..(303): a, c, t, g, unknown or other
  modified_base (354)..(354): a, c, t, g, unknown or other
  modified_base (382)..(382): a, c, t, g, unknown or other
  modified_base (477)..(477): a, c, t, g, unknown or other
  modified_base (516)..(516): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtcccctgagactctcctgtgcagcctctgcattcacccttcagtgaccacaacatggactggggtccnccaggctccgaggggaggggctgggagtgggcggaccgtattacaaggaanctaacagttacagttacagaatacggcncgtctgtgaaaaggaggttccaaccatcctacgaaagaggatgattacgaaaagactcactgtatctgacaaatgaaacagcctaggaaaacccnggaaccacggcctagtattagtgtaggtagaacaaaagngtggaatggtcggtagtagctacgtag

SEQ ID NO: 361181 - DNA, 643 bp, Homo sapiens
  misc_feature: GZ8MTXP02I6VPN.21.4.A04.1.454.CMB.2.raw
  modified_base (262)..(262): a, c, t, g, unknown or other
  modified_base (375)..(375): a, c, t, g, unknown or other
  modified_base (450)..(450): a, c, t, g, unknown or other
  modified_base (456)..(456): a, c, t, g, unknown or other
  modified_base (513)..(513): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctntgcattcaccttcagtcgaccacaacagtggactggggtcccgccgaggcctccgaaggggaacggggctgggaggttcggggtcggaccgtaagttaaccgaaaggggaaanctaaacagttacaaggttacaggtaactacgggcgcgtcgtaggtaggaaaagggtagttccaaccgtatccganaaaganataggaacttacgaaaagtactacaacttgttaactctagactaaaagtcgaaaacncggacctaaaggaaaacccggaggaaccaaccgggtaccgtagttaattaggttaggtacggtaaagaaacgtaaaagggtaggtaaggtaacgttggggttagggtacggtaacgtcgttagggtaacg

SEQ ID NO: 361182 - DNA, 691 bp, Homo sapiens
  misc_feature: GZ8MTXP02GYTEK.21.4.A04.1.454.CMB.2.raw
  modified_base (288)..(288): a, c, t, g, unknown or other
  modified_base (306)..(306): a, c, t, g, unknown or other
  modified_base (353)..(353): a, c, t, g, unknown or other
tcagtcgtcgctcgcacgaccggtgctcgatttagagtagtgatcaggggagctctgagagcggagccccagccccagaattcccaggtgttttcatttgttgatcagcactgaacacagaggactcaccatggagtttgggctgagctgggttttccttgttgttattttacaaggtgtccagtgtgaggtgcagctggtggagtcgtgggggagacttgggtccagcctgggagggtcccctgagactctcctgtgcagcctctgcattcaccttcagtgacccanaacatggactggggtccncaggctccgaggggaagggctggagtgggtcgccgtatacaaggaanctaacagttacagtacagaatacggcacgtctagtagaaaagggtaacggttcaaacccatccgtaacaaaggaagtataggtaaactttaccgaaaaaagtaaccttacaaactttggtaaactttccaggtaaccaaaaagttaaggtaaaacctaacgtaaccgtaaacggaaaacccggaaaaccgggaaaccgaaaccgggtaacccggttacggttaaacgtttaaacgtttaacgggttaacgggtttaaacggtaaaacgtaaaaacggaaaggtaagggtaaggttaacggttggggttagggttaaacggtacggtcggtttaaacgg

SEQ ID NO: 361183 - DNA, 742 bp, Homo sapiens
  misc_feature: GZ8MTXP02GMAAG.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccagccgtgggacgggtccctgagactctcctgtgcagcctctgctattcaccttcagtcgaccaacaacagtggacgtcgggtcccgccgaggcctaccggaagggggaaggggccgtaggggtaggggttcggggtccgggtaccggttaaagttaaccggaaaaggggaaaacgtccgtaaaacgtaaggtttaaacaacggttaaacgaaggtaaacgttaccgggcgtaccgttacgtagggtaaacgaaaaggggtaacgtttccaaacccgtatacctacgaaaagagtattacggaaacttaaccgaaaaaacgtaccttaccgaaacgttaggttaaacttcgaacggaaactaaaaagtacgaaaccgtaacgtaccccgaaaagggaaaaccgagggacccgaacggtccgttaggttaatttacggtagggtaacggtaagaaaaacgaaaaggtggtaagggtattagggggtagggttaggtaacgtccggtaggttaaccg

SEQ ID NO: 361184 - DNA, 711 bp, Homo sapiens
  misc_feature: GZ8MTXP02JNV4U.21.4.A04.1.454.CMB.2.raw
  modified_base (549)..(549): a, c, t, g, unknown or other
  modified_base (672)..(672): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgacgactctcctgtgcagcctctgcattcaccttcagtcgaccacaacagtcgggactcggggtcccgccgaggcctaccggagggggaacggggtccgtggggagggttcggggtaccggaccgttaaagttaaccggaaagggtaaacgtaccgtaaaacgtaacggtttaaccaaggttaacgacggtaaacgtaaccggggccgtaccgtacgttagggtaagggaaaacggggttaacggttaccaaacccgtataccgtaacgaaaggtagtataggtaacttaacgaaaagtacctanacgttagtactacgtagaacctaaaagtcgaaacgacgacccgtaaacggaaaaccggacggaacccgaccgggtaccgttagtttaagttacgttaggtaaggtaaacgaaacgtaaaaggnggtaaggaagttggtagggtagtacggtcgtaggtaacg

SEQ ID NO: 361185 - DNA, 554 bp, Homo sapiens
  misc_feature: GZ8MTXP02HXD4T.21.4.A04.1.454.CMB.2.raw
  modified_base (282)..(282): a, c, t, g, unknown or other
  modified_base (304)..(304): a, c, t, g, unknown or other
  modified_base (349)..(349): a, c, t, g, unknown or other
  modified_base (354)..(354): a, c, t, g, unknown or other
  modified_base (370)..(370): a, c, t, g, unknown or other
  modified_base (381)..(381): a, c, t, g, unknown or other
  modified_base (518)..(518): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagcctgggagggtccctgagactctcctgtgcagcctctgcattcaccttcagtnaccacaacatggactgggtccncaggctccgaggggagggctggaggtggcgccgtatacaaggaanctaanagttacagtacagaanacggcgcgtcnggtagaaaggtagttacacctatctacaaagagatgaacttacaaaagactacactgtatcgtagacaaatgaaacagtaccaacgaaaccggagtaacacgggtcgtagttatagttggtagtaagaacgaaaagngtaaggaattggtcgggtaggtacgtcgttaggacg

SEQ ID NO: 361186 - DNA, 547 bp, Homo sapiens
  misc_feature: GZ8MTXP02JKEJQ.21.4.A04.1.454.CMB.2.raw
  modified_base (263)..(263): a, c, t, g, unknown or other
  modified_base (280)..(280): a, c, t, g, unknown or other
  modified_base (288)..(288): a, c, t, g, unknown or other
  modified_base (304)..(304): a, c, t, g, unknown or other
  modified_base (382)..(382): a, c, t, g, unknown or other
  modified_base (387)..(387): a, c, t, g, unknown or other
  modified_base (407)..(407): a, c, t, g, unknown or other
  modified_base (411)..(411): a, c, t, g, unknown or other
  modified_base (442)..(442): a, c, t, g, unknown or other
  modified_base (448)..(448): a, c, t, g, unknown or other
  modified_base (450)..(450): a, c, t, g, unknown or other
  modified_base (452)..(452): a, c, t, g, unknown or other
  modified_base (455)..(455): a, c, t, g, unknown or other
  modified_base (457)..(457): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttcgtgttagttatttacaaggtgtcagtgtgaggtgcagctggtggagtcgtgggggagactttgggtccagcctgggagggtccctgagactctcctgtgcagcctntgcattcaccttcagtnaccacaanatggactggggtcccncaggctccggaggggaaggggctgggagtggggtcgaccgtatacgaaggaagctaacagttacagtacagatacggnacgtngtagaaagggaagttcacanctanaaagagatgtaatacgaaaatactacacgtntaactnananaananacagacgaacgaacgaacgacgacgtacgtagtattagtagtagtaagaacgaaagagtaagtagtaggtaggtaggtagtacgtagtag

SEQ ID NO: 361187 - DNA, 618 bp, Homo sapiens
  misc_feature: GZ8MTXP02FNI2U.21.4.A04.1.454.CMB.2.raw
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctgggggagacttggtccagcctggagggtccctgagactctcctgtgcagcctctgcatcaccttcagtgaccacaacatggactggggtcccgccaggctccgaggggagggctggagtgggtcgccgtatacaaggaaagctaaangttacagttacagaaatacggcgacgtctagtagaaaaggaaggttcaaccgattacctacgaaagaagagtagaattacaaaaagacttaccaacttaggtaactacttgaactaaaatcgaaacagaccctaaggaaaaacccgagggaaccaacgggaccgttagttaaacgttaattgggtaacggttaagaaaaccgaaaaaggtaggtaagggtaagttaggttaggggttacggttaaggccgtttaggtaacgg

SEQ ID NO: 361188 - DNA, 626 bp, Homo sapiens
  misc_feature: GZ8MTXP02IGW1N.21.4.A04.1.454.CMB.2.raw
  modified_base (482)..(482): a, c, t, g, unknown or other
  modified_base (522)..(522): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgagactctcctgtgcagcctctgcattccaccttcagtgaccacaacagtggactggggtcccgccgaggcctacccgaggggaaggggcgtgggaggtcggggtccggccggtaagttaacgaaaggaaagactaaacaggtttaacaggttaacagaaagtacggcgtcgtctaggtagaaagggagttaccaacctatctacgaagagatagattacaaagacctagactagtatntacgacaaagtacgaaacacgaccgtaaggaaaaacccgngggaaaccaccggggtccgttagttaacgtttaagttaggtaaggttaacgaaaacgaaaaggtaggtaacggtaagtagtacggggtgtaagctttaggaacg

SEQ ID NO: 361189 - DNA, 700 bp, Homo sapiens
  misc_feature: GZ8MTXP02JP2VW.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctggtattttccttgttgttattttacaaggtgtccagtgtgaggtgcagctggtggagtcgtgggggagacgttggtccagccgtgggacgggtccctgagactctcctgtgcagcctctgctacttccacctttcagtacgaaccacaaacagtcggacgtcgggtcccgccgacggcctaccggaaggggaacggggcgtgggaggtcggggtccggtaccggttaataacccgaaaggaaagtactaaacgtagtaacaagtacgaagaaacgtaccgggacgtcgtacgtaggtaaggaaaacgggtacgttaccaaacccgtagtacccgttaagaaaaggagtaagtacgtaattaaacgaaaacgtaacctctaacgttgtaactccgtaagaacctaaaagtcgaaacgacgaacccgtaacggaaaaaccggaggaacccgtaccgggtaccgtttaaggttaaacgttaggttacgggtaagggtaaacaaacgaaaaaggtggtaagggtattacggggtaggtacggttaggcgttacgg

SEQ ID NO: 361190 - DNA, 804 bp, Homo sapiens
  misc_feature: GZ8MTXP02HQ732.21.4.A04.1.454.CMB.2.raw
  modified_base (307)..(307): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgtttggtccagcctggagggtccctgagactctcctgtgcagcctctgcattcaccttcagtcgaccacaacatggactggggtcccnccaggcctaccggaaggggaacggggtctaggggacggtggggtccgggtacccggttaagttaaccgaaaaggggaaaacgtccgttaaaacgtaaggttttaaccaaggttaaaccaggtaaacgttaccggggacgtcccgttacgtaggttaaacgggaaaagggtaacgggtttacccaaacccgttagtacccctaacgaaaagggtaagaacgttaggtaaaactttaacccgaaaaaaggtaaacccttacgttaaaccttaggtttaactttacccggttaaagtaaaacctaaaagtaacggaaaaccgaccggtaaacccgtaaaaccgggaaaaaccgggaacggaaaccgtaaccgggttaccggtttaagtttaaagtttaacggtttagggttaaacggtaaaacgtaaaacgtaaaagggtaggttaagggtagtttaggggttacgggggttaaggtttacggttaggtaccggtaaacg

SEQ ID NO: 361191 - DNA, 653 bp, Homo sapiens
  misc_feature: GZ8MTXP02JNBWH.21.4.A04.1.454.CMB.2.raw
  modified_base (609)..(609): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactggggtcccgccgaggcctccgaaggggaaggggcgtgggaggtggggtcgaccgtagttacgaaaggaaagctaaacgagttacagtaacagtaatacgggcgtcgtactaggtacgaaaaggggtaacgttaccaacccgtatacgtacgaaagagtaataggtaacttaacgaaaaagtaacctacgaacttagttaactcttaggaactaaaagtacgaaacacgtacccgtaaagaaaacccggaggtaacccgaacggtccggttagttaacgtttacgtttggtaacgggtaagtaaacgtaaaaaggnggttaagggaagttagggtgggtacggtaggacgttggtaaccg

SEQ ID NO: 361192 - DNA, 588 bp, Homo sapiens
  misc_feature: GZ8MTXP02FNI1P.21.4.A04.1.454.CMB.2.raw
  modified_base (560)..(560): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaaccacaacatggactggggtcccgccgaggcctaccgaggggaaggggctgggagggttggggtccggaccgtaagttaacgaaagggaaacgctaaacgagttacaagtaacagaaatacgggcgcgtctgtaggaaagggtaagttcaaccgatctacaaagagatagaattacgaaaagtactacactagtatctagaacaaatacgaaacagacctaaaggaaaaccgaggaaccacggtaccgttagtattagtggtaggtaagaaacaaaagnggtaaggatggtaggtgagcgtagtacg

SEQ ID NO: 361193 - DNA, 815 bp, Homo sapiens
  misc_feature: GZ8MTXP02FRQBM.21.4.A04.1.454.CMB.2.raw
  modified_base (266)..(266): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccgtgggacgggtccctgagactctcctgtgcagcctntgctattccaccttcagtcgaaccacaacagtcggacgtcgggtcccgccgaggccctaccggagggggaacggggctggggagggttcggggtaccggaccgttaaagttaacgaaaagggtaaaacgtccgtaaaacgtaacggtttaaccaaagtaaccgaaggtaaacgtaacccgggggtcgtaccggttacgtaggtaaaggggtaaaaaacgggaaaccgggttttaccaaaaccccgttagttacccgttaaacgaaaagggttaaggaactttaagggtaaaactttaaccgaaaaaaacgtacccttaaaccgtaaaccttaggttaaacttacccgttagggaaaaccgtaaaaattccgggaaaaaccttacggaaacccgtaaaaacgggaaaaaccccgggaagggtaaaacccgaaccggggttaccgtttaaggtttaaattttaacggttggtaaacgggttaaacgaaaaacggtaaaagggtaggttaaggaagttggggtacgggtttaggaacggtcgtaggttaacg

SEQ ID NO: 361194 - DNA, 606 bp, Homo sapiens
  misc_feature: GZ8MTXP02GKGVP.21.4.A04.1.454.CMB.2.raw
  modified_base (303)..(303): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactcgggtccnccaggcctccgaggggagggcgtggaggtgggtcggcgtatacgaaggaagctaagagttacagtacagtaatacggcgcgtctaggtagaaaagggtagttcaacccgatcgtacaaagagatagaattaacaaaagtacctacacttagtactctagaactaaaagtcgaaacacggtacctaaacggaaaaccggacgggaaccgaaccggtaccggttagttaaattagttaggtacggtaagaaaacgaaaaggtaggtaagggtaagtggtacggggtagtaggtacgttaggtacg

SEQ ID NO: 361195 - DNA, 574 bp, Homo sapiens
  misc_feature: GZ8MTXP02FO5X4.21.4.A04.1.454.CMB.2.raw
  modified_base (216)..(216): a, c, t, g, unknown or other
  modified_base (264)..(264): a, c, t, g, unknown or other
  modified_base (277)..(277): a, c, t, g, unknown or other
  modified_base (353)..(353): a, c, t, g, unknown or other
  modified_base (375)..(375): a, c, t, g, unknown or other
  modified_base (412)..(412): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgagactctcctgtgcagcctntgcattcaccttnagtgaccacaacatggactgggtccgcaggctccgagggaggggctggagtgggtcgcgtatacgaaggaagcaanagttacagtacagaatacggcngtctgtagaaaggtaagttcaaccatactacgaaagngatgaattacaaaagactacaacttgaatctagaactaaaatgaaacacgacccgtaaaggaaaaacccggaggtaaccgaacgggtaccgtaggttaaattagttaggtagtaaagaaacaaaaggtgtaagggatagggtgggtagtaggcgtagtaacg

SEQ ID NO: 361196 - DNA, 552 bp, Homo sapiens
  misc_feature: GZ8MTXP02F01RB.21.4.A04.1.454.CMB.2.raw
  modified_base (304)..(304): a, c, t, g, unknown or other
  modified_base (515)..(515): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtgaccacaacatggactggggtccnccaggcctccgaggggagggctggaggtgggtcgccgtatacgaaggaagctaaacagttacagtacagaatacggcgcgtctaggtagaaaagggtaagttcaaccgtatactacaaagagatagaattacaaaagactacgactgtaatctagacaaaatcgaacagaccctaagaaaaccgagacacggcgtagtattagtgtagtanaacaaagagtggatggtacggtagtacgcgtagtacg

SEQ ID NO: 361197 - DNA, 608 bp, Homo sapiens
  misc_feature: GZ8MTXP02GTGV9.21.4.A04.1.454.CMB.2.raw
  modified_base (509)..(509): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgatctgggttttccttgttgttattttacaaggtgtccagtgtgaggtgcagctggtggagtcgtggggggagacttgggtccagccgtgggagggtccctgagactctcctgtgcagccctctgcattccaccttcagtcgaaccacaacagtggactggggtcccgccaggcctccgaggggaaggggctggaggtgggtcgaccgtatacgaaaggaaagctaaacagttacagtacaggaactacggcgcgtctaggtagaaaagggaagttccaaccgatactacgaaagagatagaattacaaaagactacgacttagtatacgtagacaaatacgaaacagacctaaaggaaaaccgnggaacgacgggtaccgttagtaatttagttaggtacggttaaacgaaacgaaaaggtaggtaagggtatagggttagggtaggtacgtcgtaggtaacg

SEQ ID NO: 361198 - DNA, 810 bp, Homo sapiens
  misc_feature: GZ8MTXP02GPKH1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagccgtgggacgggtccctggacgactctccgtgtgcacgcctctgctattcaccttcagtcgaacccacaacagtggaccgtcggggtccccgccgaagggccctaccggaaggggggaacggggtccgttaggggacgggttcggggtaccgggtaccgttaaacgtttaaccggaaaagggggtaaaaacctaccgtaaaacgtacgggtttaaaccaaacgggttaaacgtacggggaaaacgttaccgggggccgtaccggttcgttaaggggttaacggaaaaagggggtaaaccgtttccaaaccctagttaccctaacggaaaaggtagtaattcgtaaaacgtttaaccgaaaaaacggtaccttacgtaaacgttaggttaaccttacgtaacggaaacctaaaagtacgaaaacctacggtaacccgtaaaacggaaaaccgggtacggaaaaccgtaccgggttaccgttaaggtttaatttaacggttagggtaacgttaaaacgaaaaccgaaaaggttaggtggttaaagttggggttaaggtagggttaacgtcgtttaggaacccg

SEQ ID NO: 361199 - DNA, 523 bp, Homo sapiens
  misc_feature: GZ8MTXP02FK49T.21.4.A04.1.454.CMB.2.raw
  modified_base (417)..(417): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggaggggtccctgagactctcctgtgcagcctctgcatcaccttcagtgaccacaacatggactggggtcccgccaggctccaggggaaggggctgggagtggggtcggccgtattacaaggaaagctaaacagttacagtacagaaatacggcgcgtctgtgaaaggaaggttcaccatctcaaganatgattcaaaagaactcactgtatctgcaaaatgaaacagcctgaaaaccgaggacacggccgtgtattattgtgtagacaaaagagtgatgtggtggtagctgtg

SEQ ID NO: 361200 - DNA, 614 bp, Homo sapiens
  misc_feature: GZ8MTXP02JFI9J.21.4.A04.1.454.CMB.2.raw
  modified_base (577)..(577): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggccgtgggacgggtccctgacgactctcctgtgcagcctctgcattccaccttcagtcgaaccacaacagtggactggggtcccgccgaggcctaccggaggggaacggggctgggaggtggggtccgccgtaatacgaaggaaagctaaacagttacagttaacaggaactacgggcgtcgtcgtaggtagaaaagggtacgttccaacgtatctaacaaagagatcgtaattacgaaaagtactacaacgttgtaactctaggaacaaaatacgaaactacgacccgtaaaggaaaaccgaggacacgggtctagttattacgtagtacggtaagaaacgtaaagnggtaaggaagttggtagggtagtacgtcgttagtacg

SEQ ID NO: 361201 - DNA, 576 bp, Homo sapiens
  misc_feature: GZ8MTXP02FVRU2.21.4.A04.1.454.CMB.2.raw
  modified_base (199)..(199): a, c, t, g, unknown or other
  modified_base (242)..(242): a, c, t, g, unknown or other
  modified_base (271)..(271): a, c, t, g, unknown or other
  modified_base (296)..(296): a, c, t, g, unknown or other
  modified_base (389)..(389): a, c, t, g, unknown or other
  modified_base (419)..(419): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctccaggctcagaaaccacggagaattgtgttgacgcagtctccaggcacctgtctttgtctccgaggggaaanacgccaccctctcctgcagcctccagccaagaatactccaganctactacatacgcctggtaccagcagaancctggccaggcctcccgaggttccnatctatgctcggtccacgcgggcccacgtggcacgtcccaagactacggttcgaggtgacgtagggtcggtctggggacaggtactcactctnactcattagcacgacgtgacgctagaagtnttacgctagtgtacttagtgtacagtctaagtacgtagtaacgttcgaccttcgtcggtcggttacggaccgtaaagggaaccgtaaaggtaaagtaaaacgtaacggaaaacgtaacgtaagggtacgacgtacgtacaacgtacgttactttacg

SEQ ID NO: 361202 - DNA, 603 bp, Homo sapiens
  misc_feature: GZ8MTXP02GVI07.21.4.A04.1.454.CMB.2.raw
  modified_base (203)..(203): a, c, t, g, unknown or other
  modified_base (296)..(296): a, c, t, g, unknown or other
  modified_base (449)..(449): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatacgcctggtaccagcagaacgcctggccaggcctcccaggttcccnatctatgctcggtcccagacgggcccacgtggcactccccaagacacggttcagtggacaggtgggtctggggacaggtaccttcactctacatcagttagctagacgtggacgcctagaagtagttcgacgtagttcttattacgtgtaacngtactagtagtaggtaacgttacctaccgttcgttcggttccggttaccgggaccggtaaacggggtaacccgtaaaaggggtaaacgaaaacgtaacggaaaacgtaacgtaaggtacggtacgttacggacctaaccgtacttacgtttacg

SEQ ID NO: 361203 - DNA, 630 bp, Homo sapiens
  misc_feature: GZ8MTXP02GFIL4.21.4.A04.1.454.CMB.2.raw
  modified_base (202)..(202): a, c, t, g, unknown or other
  modified_base (293)..(293): a, c, t, g, unknown or other
  modified_base (365)..(365): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttccnatctatgctcgggtccccagagggcccatcggcactcccaggacaggttcagtggcaggtgggtctgggacngtacttcactctacatcattagcaagtacgtgggacgccgtaaggtaaacgtacgtttcggactaaggttagttaaactttaaccgtggttaccaaggtacgtaaaggtttaacgttaggggtaaaacgttttcccaacccgtttacgttcgggttccggttaccgggaacccggtaaaaggggaaaccgtaaaagggtaaagtaaaacgtaacggaaaaacgtaacgtaaggtacggtacgtcggacctaacctagttcttacg

SEQ ID NO: 361204 - DNA, 630 bp, Homo sapiens
  misc_feature: GZ8MTXP02JNKEF.21.4.A04.1.454.CMB.2.raw
  modified_base (203)..(203): a, c, t, g, unknown or other
  modified_base (296)..(296): a, c, t, g, unknown or other
  modified_base (432)..(432): a, c, t, g, unknown or other
  modified_base (461)..(461): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatacgcctggtaccagcagacgcctggccaggcctcccgaggttcccncatctatcgctcgggtcccagcgggcccagtggccacgtccccgaagactacgggtttccaggttcggacgtagggttcggggtctagggggacaggtacctttcgacttctacatacattagcagtactaggacnccgtagaacgtacgtttcgctaaggtttnttaacgttagtgtacgagtactaaggttagtacggttaacttcgtaccgttcgtcggttaccggttacgggaccgtaaacggggtaaaccgtaaagggtaaacgtaaaacgtaacggtaaacgtaacgttcggtacggtacgtacgacctaccgtacgttacgtttacg

SEQ ID NO: 361205 - DNA, 828 bp, Homo sapiens
  misc_feature: GZ8MTXP02FQG5H.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccgagtgtgaggtgcagcgtggtggagtcggtggggatacgttcggccagtccgtgggacggtccctagacgtacctctccgtgtcgcacgtccctcgtcgctacttacctaccttcgaggtaccaacccaaccaaacgtagtcgggtaccgtccggggtaccccaccggacggcccgtaccgggaagggggacgggtccgtaggggacggggttcggggtacccggtacggttaaacgttaaaccggaaaagggtaaacgtacccgtaaaacgtacggtttaaaccgaaggttaaccgaggtaaaccggtacccggggacgttacccgttacgttagggtaaaaggggtaaaacgggtttaaaccggttcccaaaacccgttagtttaacccgtaaacggaaaagggtaaagtacgttaaagtaaaaccgtttaaacgaaaaaaaacgtcctttaaccgtaacgttaggttaacttacgtaacgaaaacctaaaagtaccggaaaacctaacggacccgtaaaaacggaaaacccggacgggaccgtaacccggtacgtttagttaatttaggtaggtaaacggtaaacgaaaacgtaaaggttggtaaggtacgttaggggtacggtaggtacgtcggtagtaacg

SEQ ID NO: 361206 - DNA, 609 bp, Homo sapiens
  misc_feature: GZ8MTXP02JDUH2.21.4.A04.1.454.CMB.2.raw
  modified_base (518)..(518): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacatggactcggggtcccgccaggcctccgaggggaagggctgggagtgggtcggccgtatacaaggaagctaacagttacagtacagaatacggcgacgtctaggtagaaagggtaaggttccaaacccgtatcctacgaaagagtataggaacttaaccaaaagaaccttcgaacttagtactccgtagacctaaaatcggaaacacgtacccgtaaggaaaaacccgngggaaccacgggtccgttaggttaattagttggaaggtaacgaaaacgaaaaggaggttaagagttaggtagggtagtagtcgttagaccg

SEQ ID NO: 361207 - DNA, 586 bp, Homo sapiens
  misc_feature: GZ8MTXP02HXZRZ.21.4.A04.1.454.CMB.2.raw
  modified_base (276)..(276): a, c, t, g, unknown or other
  modified_base (304)..(304): a, c, t, g, unknown or other
  modified_base (428)..(428): a, c, t, g, unknown or other
  modified_base (435)..(435): a, c, t, g, unknown or other
  modified_base (576)..(576): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctggagggtccctgagactctcctgtgcagcctctgcattcaccttnagtgaccacaacatggactggggtcccncaggcctccgaggggaagggctgggagtcgggtcgaccgtattacgaaaggaaagctaaacagtttacagttaacaggaatacggcgaccgtgtaggtagaaaagggagttcaacccgatctanaaagagntagatacgaaagaactcacttagtatctagacaaaagtgaaactagacctaagaaaacccgaggaccacggtccgtagttaatttagtaggtaggtaacgaaacaaaaggtagtggtaaagtggttagggtaggtaaccgngtttaggacg

SEQ ID NO: 361208 - DNA, 606 bp, Homo sapiens
  misc_feature: GZ8MTXP02GS6TX.21.4.A04.1.454.CMB.2.raw
  modified_base (286)..(286): a, c, t, g, unknown or other
  modified_base (352)..(352): a, c, t, g, unknown or other
  modified_base (359)..(359): a, c, t, g, unknown or other
  modified_base (464)..(464): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacgttgggtccagccgtgggaggggtcccctgagactctcctgtgcagcctctgcattcaccttcagtnaccacaacatggactgggtccgcaggctgtaggggagggctggagtgggcgcgtatacgaaggaanctaaacngttacagtaacagaatacgggcgcgtctggtaaggaaagggaagttcaaccgtatctacaaaggagtatgtaattaccaaaagaactacaacttgtaattcgaanaacgaaatacgaaacacgaccgtaaacggaaaaccggaggaaccgtaccggtacgttagttaatttacggttaggtaacggtaaacgaaaacgtaaaaggtaggtaaggtagtagggttagggtaggtacgtcgttagtacg

SEQ ID NO: 361209 - DNA, 620 bp, Homo sapiens
  misc_feature: GZ8MTXP02IPD53.21.4.A04.1.454.CMB.2.raw
  modified_base (201)..(201): a, c, t, g, unknown or other
  modified_base (266)..(266): a, c, t, g, unknown or other
  modified_base (268)..(268): a, c, t, g, unknown or other
  modified_base (271)..(271): a, c, t, g, unknown or other
  modified_base (283)..(284): a, c, t, g, unknown or other
  modified_base (286)..(286): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctctcctgcagcctccagccagaatactccagagctactacatacgctagacagcagacncngcngcctcgcgtccnntntatcgcgtcggccagcggccacgtgcctacgtcccaagtacgtcggttaccgaggtcggacgtagggttcggtcgtcggggaactacgtacccttaccaccgttctactagtactagtacgcaacgtacgtaggtacgtaccgtaaggtaacgtacgttacgacgttaggttacgtttacgttacgtgtacgtagtacgtaagttagttacggtaacttcctacgttcgtcggttacggttaccggaacggtaacggtaaccgtaaaaggtaacgtaaaacggtaacgtaacgtaacgtggtacgtacgtacgactaccgtacgttacgttacg

SEQ ID NO: 361210 - DNA, 616 bp, Homo sapiens
  misc_feature: GZ8MTXP02I93KS.21.4.A04.1.454.CMB.2.raw
  modified_base (360)..(360): a, c, t, g, unknown or other
  modified_base (365)..(365): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccgtgggagggtccctgagactctcctgtgcagcctctgcattcaccttcagtcgaccacaacagtcggactggggtcccgccgaggcctaccgaggggaagggctggagtgggtcgcgtatacgaaggaanctaanagttacagtacagaactacggcgcgtcgtggtacgaaaggtagttccaaccatctacgaaagagatagaattacaaaagaactacgaacttgtaactctagaactaaaagtcgaaacgacgaccgtaaacggaaaacccggtagggaaacccgaccgggtaccgttaagtttaaagttacggttaggtaacgggtaaagaaaacgtaaaaagtggtaagtaagtggttagggtacgtaagcgtttagaacg

SEQ ID NO: 361211 - DNA, 760 bp, Homo sapiens
  misc_feature: GZ8MTXP02JARTW.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttatttacaaggtgtccagtgtgaggtgcagctggtggagtcgtgggggagacgttggtccagccgtgggagggtccctggagacctctcctgtcgcagcctctgctacttccaccttcagtcgaaccaacaacagtgggacgtcggggtccccgaccgacggcccgtaccggaagggggtaacggggccgtggggtagggttccgggggtaccggtaccgttaaagttaaccgaaaaggggtaaaacgtactaaaacgtaagtttaaccaagttaacaggtaaactacggggacgtacgtcgtaggtaacgggaaaagggtaaacggttccaaacccgtaagtccgtaacgaaagtagtagtacgtaaacttaaacgaaaagtaacctcgtaactttaggtaactacgttacggaaactaaaacgtagaaaaccgtaacggtacccgtaaaaccggaaaaaacccggaggggtaaaacccgaaccggggttaccgtttaaggttaaagtttaaacgttggttaaaagggtaaacgaaaacgtaaaaggtggttaagggtaagttgggtacggggttaggacgttccgtaggtaacg

SEQ ID NO: 361212 - DNA, 590 bp, Homo sapiens
  misc_feature: GZ8MTXP02IVYDJ.21.4.A04.1.454.CMB.2.raw
  modified_base (202)..(202): a, c, t, g, unknown or other
  modified_base (211)..(211): a, c, t, g, unknown or other
  modified_base (293)..(293): a, c, t, g, unknown or other
  modified_base (338)..(338): a, c, t, g, unknown or other
  modified_base (400)..(400): a, c, t, g, unknown or other
  modified_base (424)..(424): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggcctcccgaggttccnatctatcgctgggtccccagacgggccacgtggccatcccagacnggtcagtgcaggtgggtctggggacagaccttcgactctacatcattagcagtactgggacnccgtagaagtatttcgctaggttnttaattacgtgtacagtcaagttactagggaacttctaccgttgtacggttccggttacggaccgtaaacggggtaaccctaaaaggggttaacgtaaaagtaacggtaaaaacggtaacgttcggttaggaccgttacgaacccgaacctagtttaccgtttcgg

SEQ ID NO: 361213 - DNA, 595 bp, Homo sapiens
  misc_feature: GZ8MTXP02JGFNS.21.4.A04.1.454.CMB.2.raw
  modified_base (322)..(322): a, c, t, g, unknown or other
  modified_base (555)..(555): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgacccacaacatggactgggccgcacggctccgaggggagggcngggagtgggtcgcgtatacgaaggaacgctaacagttacagtaacagacgtacggcgcgtctagtaggaaaggtaggttccaaccgtatctacgaaaggagatgtaattacaaaagacctcactagtatacgtagaactaaagtagaaaccacgtaccgtaaaggaaaacccggaggaaccgaccggtaccgttaagttagtttagtggtaaggtaacgaaacgtaaaaaggnggttaggaagttgggtaggtagggtatacgtgtagtaacg

SEQ ID NO: 361214 - DNA, 597 bp, Homo sapiens
  misc_feature: GZ8MTXP02HEAGP.21.4.A04.1.454.CMB.2.raw
  modified_base (216)..(216): a, c, t, g, unknown or other
  modified_base (418)..(418): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcaccttcagtcgaccacaacatggactgggtcccgccaggctccgaggggaagggctggagtgggcgccgtatacgaaggaagctaacagttacagtaacagaatacggcgcgtctggagtaaaagggaagttccaaaccgtatcctanaaagagtaatagaattaccaaaagtaacctacacttgtaactctagaacaaatgaaacaggaccctaaggaaaaacccgagggaaaccacgggtacctaggttattaacgttggtaaacggtaagaaacgaaaaggaggtaaggataggttagggtacggttagaccgtttaggaaccg

SEQ ID NO: 361215 - DNA, 713 bp, Homo sapiens
  misc_feature: GZ8MTXP02HLR6A.21.4.A04.1.454.CMB.2.raw
  modified_base (200)..(200): a, c, t, g, unknown or other
  modified_base (233)..(233): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgagggaaangccaccctctcctgcagctccagccaagaatanccagagctactacatagcctaggtaccagcagaacgcctggccaggcctcccgaggttcccctcacttctatcgcgtcgggtccccaacgcgggcccacgtggaccacgtccccaagactacggttccaggtcggacaggttcggggtctagggggactacggtacctttaccgaacttctaactactacctagttacggcaaacggtacctaggggaacgtcccgtaaggaaacgttacgtttaccgacgtaagtttacgttaaactttaccgttgtaccgttaaggaccgtaacggttaagttacggggtaaactttccgaacccgtttacgttcgggttacccggtttaccgggaaacccggttaaacggggaaacccgtaaaaggggttaaacgtaaaacggtaaacggtaaaacccggtaacggttaagggtacggacgttaccggaaccgtaaacccgttacgtttacggtacg

SEQ ID NO: 361216 - DNA, 633 bp, Homo sapiens
  misc_feature: GZ8MTXP02FS8L5.21.4.A04.1.454.CMB.2.raw
  modified_base (265)..(265): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggaggtcgtgggggagacttggtccagccgtggagggtccctgagactctcctgtgcagcctntgcattcaccttcagtgacccaacaacatggactggggtcccgccaggctaccgaggggacggggctggaggtgggtcggccgtattacgaaggaaagctaaacgagttacaagtaacaggtaaatacgggcgacgtcgtaggtagggaaaagggtaacgttcaaccctatacctagaaagagtaatagaactttacgaaaaagtaaccttacgaacttagttaactcgtagaaacctaaaatcgaaaacaggaccctaaaggaaaaacccgaggacccgaaacgggccgttagtaaactttagttaggtaacggtaagaaaacgtaaaaggagtaagggaatggttaggggtcgtaagcgtggtacg

SEQ ID NO: 361217 - DNA, 560 bp, Homo sapiens
  misc_feature: GZ8MTXP02JC3F8.21.4.A04.1.454.CMB.2.raw
  modified_base (305)..(305): a, c, t, g, unknown or other
  modified_base (360)..(360): a, c, t, g, unknown or other
  modified_base (411)..(411): a, c, t, g, unknown or other
  modified_base (416)..(416): a, c, t, g, unknown or other
  modified_base (478)..(478): a, c, t, g, unknown or other
  modified_base (523)..(523): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtcaccacaacatggactcggggtccnccgaggcctccgaggggaagggctggagtgggtcgcgtatacgaaggaagctaanagttacagtacagaatcggcgcgtctggtagaaaggtagttcactatctanaaganatgaattacaaaagactcactgtactcgtagacaaatcgaaacagacctaagaaaacccggngaccacggtcgtagtattagttggtaggtaacgaaacgtaaaagnggtaagtaacgtggtacgggtggtaagcttaggtacg

SEQ ID NO: 361218 - DNA, 579 bp, Homo sapiens
  misc_feature: GZ8MTXP02JRZUC.21.4.A04.1.454.CMB.2.raw
  modified_base (568)..(568): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattccaccttcagtcgaccacaacatggactcgggtccgccgaggctccgaggggaggggctgggagtgggcggccgtatacgaaggaacgctaacagtacagtacagagtacgggcgcgtactggtagaaaagggtaggttaccaccgatctacgaagagtatgaattacaaaagtactacaactgtatcgtagacaaatcgaaacacggacctaaggaaaaccgaggaaccgacgggtccgttagtaattagtacggtaggtaagaacgaaaaggtggtaggaagtgggtaggtcgggtancgtggtacacg

SEQ ID NO: 361219 - DNA, 658 bp, Homo sapiens
  misc_feature: GZ8MTXP02F574Z.21.4.A04.1.454.CMB.2.raw
  modified_base (217)..(217): a, c, t, g, unknown or other
  modified_base (266)..(266): a, c, t, g, unknown or other
  modified_base (278)..(278): a, c, t, g, unknown or other
  modified_base (302)..(302): a, c, t, g, unknown or other
  modified_base (359)..(359): a, c, t, g, unknown or other
  modified_base (365)..(365): a, c, t, g, unknown or other
  modified_base (448)..(448): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttggtccagccgtgggagggtccctgagactctcctgtgcagcctntgcatcaccttnatgaccacaacatggactgggccncaggcctccgaggggaacgggctgggaggtcgggtcggcgtagtaacgaaaggaaanctaaanagttacaagtaacagaactacgggcgcgtcgtaggtaaggaaaagggtaacggtttccaaaccctattacctagaaaagaagnttaaggaatttaaccgaaaaagtacttacgtaaactgtaaactccgtagaactaaaaatcgaaaaccacggaacccgtaaaacggaaaaaccccggaggtaaaacccgaaccgggtaccgtttaagttaaattttaacgtagggttaagggtaaaccaaaacgaaaaaggtggttaagggattacgggtaggtaggtagcgtaggtaacg

SEQ ID NO: 361220 - DNA, 587 bp, Homo sapiens
  misc_feature: GZ8MTXP02GEOW4.21.4.A04.1.454.CMB.2.raw
  modified_base (430)..(430): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccctgggagggtccctgagactctcctgtgcagcctctgcattcaccttcagtcgaacccacaacatggactggggtcccgccaggctccgaggggaagggctgggagtgggtcgccgtatacaaggaaagctaacgagttacagtaacagaatacggcgacgtctaggtacgaaagggtaaaggttcaacccgatacctanaaagagatgaattacgaaaagaactacgactgtattaccgtgactaaatacgaaactacgaccgtaagaaaacccgaggaaccgacggccgttaggtatttagtaggtaggtaacgaaacaaagagtaaggagtggtaggtcggtagtcgttgtacg

SEQ ID NO: 361221 - DNA, 573 bp, Homo sapiens
  misc_feature: GZ8MTXP02GBWW7.21.4.A04.1.454.CMB.2.raw
  modified_base (306)..(306): a, c, t, g, unknown or other
  modified_base (359)..(359): a, c, t, g, unknown or other
  modified_base (389)..(389): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtcgaccaacaacatggactggggtcccnccaggcctccgaggggaagggcgtggaggtgggtcgcgtaatacgaaggaaanctaaacagttaacagtaacagaaatacggngcgtctagagaaaggagttcaccatcacaagagatagaattacaaaagactacaactgtaatctagacaaaatcgaaacagacctaaggaaaacccgaggaaccacggccgttagtaattagttggtacggttaaagaacaaaaggtagtaaggggattagggtggtacggtagtctaggtacg

SEQ ID NO: 361222 - DNA, 581 bp, Homo sapiens
  misc_feature: GZ8MTXP02IOER0.21.4.A04.1.454.CMB.2.raw
  modified_base (308)..(308): a, c, t, g, unknown or other
  modified_base (430)..(430): a, c, t, g, unknown or other
  modified_base (502)..(502): a, c, t, g, unknown or other
  modified_base (523)..(523): a, c, t, g, unknown or other
  modified_base (546)..(546): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctgggtggagtcgtgggggagacttggtccagcctgggagggtcccctgagactctcctgtgcagcctctgcattccaccttcagtgacccacaacatggactggggtcccnccaggctaccgaggggagggctgggagtggggtcgccgtaattacgaaaggaaagctaaacagttacagttaacagaaatacggcgcgttcgtggtagaaagggaagttcaaccgatcctanaaagagatagtaattacaaaagaacttacgacttgtactactgactaaaatgaaacagcctaagaaaaccgngaccacggaccgttagtattnttaggtaggtaagaacaaaaggnggtaaggagttgggtagggtaggtacgtgttagcg

SEQ ID NO: 361223 - DNA, 633 bp, Homo sapiens
  misc_feature: GZ8MTXP02I05QN.21.4.A04.1.454.CMB.2.raw
  modified_base (301)..(301): a, c, t, g, unknown or other
  modified_base (422)..(422): a, c, t, g, unknown or other
  modified_base (428)..(428): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccncaggcctccgaggggaggggctgggaggtggggtcgccgtattacgaaggaaagctaacagttacaagttaacagaatacgggcgtcgtcgtgtagaaagggtaacgttcaaccatcctanaaaganatgaattacaaaagactcacttgtaactcgtagactaaaatcggaaacacgtaccctaaaagggaaaacccggagggaaaccgacccgggtaccggttagttaaacgttttattacggggttaacgggtaaagaaaacgtaaaagggtggttaaggggtagttaccggggttaggggtaggttacggacgtttagggttaaccgg

SEQ ID NO: 361224 - DNA, 555 bp, Homo sapiens
  misc_feature: GZ8MTXP02HBDQO.21.4.A04.1.454.CMB.2.raw
  modified_base (202)..(202): a, c, t, g, unknown or other
  modified_base (297)..(297): a, c, t, g, unknown or other
  modified_base (385)..(385): a, c, t, g, unknown or other
  modified_base (397)..(397): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccagagctactacatagcctggtaccagcagaagcctggccaggcctacccaggttccctnatctatcgctgggtccccagacggcccacgtggcatcccagacaggttcagtgctaggtggctgggacagtctcactctcatcattancagtactggacncctagaatatttccgatagtgtatactgtcagtcagtatggaattcgacttcgtagtccgtacggacgaaacgggtaaccaaagggtaaagtaaaacgtaacggaaaaccgtaaacgtcggttagaccgttacacccggaaactacgttacgtttacg

SEQ ID NO: 361225 - DNA, 552 bp, Homo sapiens
  misc_feature: GZ8MTXP02GMW6N.21.4.A04.1.454.CMB.2.raw
  modified_base (304)..(304): a, c, t, g, unknown or other
  modified_base (348)..(348): a, c, t, g, unknown or other
  modified_base (482)..(482): a, c, t, g, unknown or other
  modified_base (520)..(520): a, c, t, g, unknown or other
  modified_base (551)..(551): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatggactggggtccnccaggcctcgaggggagggctggagtgggcgctatacaaggaanctaacagttacagtacagaatacgggcgacgtctaggtaggaaaagggtaacgttcaaccgtatcacaaagagatgaattacaaaagactacactgtatctagacaaaatgaaacaggacctaaggaaaaccgngacacggtctagtattagtgtaggtaacaaacgaaagnggtaagtagtggtaggtacggtagtcgtagng

SEQ ID NO: 361226 - DNA, 674 bp, Homo sapiens
  misc_feature: GZ8MTXP02GZOT8.21.4.A04.1.454.CMB.2.raw
  modified_base (201)..(201): a, c, t, g, unknown or other
  modified_base (241)..(241): a, c, t, g, unknown or other
  modified_base (296)..(296): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaatactccaganctactacatacgcctaggtaccagcagacgcctggccaggcctcccgaggttccnatctatcgcgtcggtcccagacggcccagtggccactcccgaagacgtacggttcaggtcggcgtaggttcggggtctcgggggactaggtacctttcgaccttctactactctagttacgcaaggtaccgtgggactccgtagtaagtacgtttacggcttaaaggttcggttaaattacgtacgtacctaaggtaccgttaaggttacggttaagggttaactttaccgacccgtttacggttcgggttacccggttaccgggaacccggtaaaacggggtaacccgtaaaaggggtaaacgtaaaacgtaacggtaaaaccgtaggttaacggtacggaaccgttacggaccctaaccgtacgttacgtttccgg

SEQ ID NO: 361227 - DNA, 763 bp, Homo sapiens
  misc_feature: GZ8MTXP02HEUYH.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtgggggagacgttggtccagccgtggagggtccctgagactctcctgtgcagcctctgctattccaccttcagtcgaccaacaacagtggacgtcggggtcccgccgaggccgtaccggaaggggaacggggtcgtggggaggttcgggggtccgggtaccgttaaagttaaacggaaaacggggtaaaacgtaccgtaaaacgtaacggtttaaccgaaggttaaaccaagggtaaacgttaccggggaccgtcgtacgtagggtaagggaaaagggtaacgttccaaacccgtataccgtacgaaaaggatagtagtaacttaacaaaaaggtaccttacgaacgttgttaaacttccgtaagtaacctaaaaagttacgaaaacccgaggtaaccccgtaaaacggaaaaaacccgggtaggaaacccggttaaccggggtaccgttaaggtttaatttaacggttacgggttaacgggtaaacgaaaacggtaaaaaggtgggtaaggtaagttcggggtaggggttacggtaacggtcgtaggttaaccg

SEQ ID NO: 361228 - DNA, 623 bp, Homo sapiens
  misc_feature: GZ8MTXP02GHLUC.21.4.A04.1.454.CMB.2.raw
  modified_base (198)..(198): a, c, t, g, unknown or other
  modified_base (291)..(291): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgtctccgagggaaangccaccctctcctgcagctccagccagaatatccagagctactacatacgcctggtaccagcagaacgcctggccaggcctcccaggttcccnatctatcgctcgggtccccacgacgggcccacgtcggccactcccgaagtacgtacggttccgaggtcggacgtaggttcggggtcgtgggggaactaggtacctttcaacttctcattcattacgcagacgtcgagcctaggaaagtacttcgacgtagttagttaacttactgtacaggtacaaggttagttacgggtaacgttacaccttcgtcggttacggttaccgggaaccggtaaacgggaaccgtaaaagggtaaacggtaaaacgttaacggaaaaccgtaacgtaaggtacggtactacggaccgtaacctagtcgtttacg

SEQ ID NO: 361229 - DNA, 583 bp, Homo sapiens
  misc_feature: GZ8MTXP02H2KZD.21.4.A04.1.454.CMB.2.raw
  modified_base (510)..(510): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacgttggtccagccgtgggagggtccctgagacctctcctgtgcagcctctgcattcaccttcagtcgaccacaacatggactggggtcccgccgaggcctccgaggggaaggggctgggaggtggggtcgccgtattaacgaaggaaagctaaacgagttacagttaacaggaaacttacgggcgcgttcgtaggaggaaaagggaagttccaacctatctaacgaaagagtatgaattacaaaagaactcaacttgtaatcgagacaaatgaacagacctagaaaaccgngacacggcgtagtattatggtacgtagaaacaaaaggtggtaaggatgggtaggtaggtacgtcgttaggacg

SEQ ID NO: 361230 - DNA, 619 bp, Homo sapiens
  misc_feature: GZ8MTXP02FKTJ3.21.4.A04.1.454.CMB.2.raw
  modified_base (357)..(357): a, c, t, g, unknown or other
  modified_base (381)..(381): a, c, t, g, unknown or other
  modified_base (386)..(386): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccgccaggctcgaggggaagggctggagtgggtcgcgtatacgaaaggaagctaaacngttacagttaacagaaatacgggngcgtntaggtagaaaagggtaacgttcaacccatacgtacaagagatgaattacaaaagacctacactagtaatcgtagaacaaaagtcgaaaacgacgacccgtaacggaaaaacccggagggaaaccctaaccggggtacccgttaggttaatttaagttaggtagggttaaaagaaaacgaaaaaggtaggtaagggtaagttaggtagggggttacggtaagtcgtaggtacgg

SEQ ID NO: 361231 - DNA, 577 bp, Homo sapiens
  misc_feature: GZ8MTXP02F83V8.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgcgcagcctctgcattcaccttcagtgaccacaacatggactggggtcccgccaggcctccgaggggaacggggctgggaggtggggtcggccgtattacgaaggaaacgctaaacagttacaggtacagaatacgggcgcgtctggtagaaaagggtaaggtttcaaacccgtatcgtacaaaagagattaggaatttacaaaaagtacctcaactgtaactctgacaaaatgaaacagcctaagaaaacccgaggaccaacgggtcctagtattattgtaggtaagaacaaaagagtaaggatggtaggtcggtagctggtac

SEQ ID NO: 361232 - DNA, 582 bp, Homo sapiens
  misc_feature: GZ8MTXP02I5BAO.21.4.A04.1.454.CMB.2.raw
  modified_base (303)..(303): a, c, t, g, unknown or other
  modified_base (447)..(447): a, c, t, g, unknown or other
  modified_base (455)..(455): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccncaggctcgaggggaaggggctgggagtggggtcggccgtattacaaagggaagctaaacagttacaggtaacaggaactaacgggccgcgtactaggtagaaaaggggtaaggttcaaacccgtatctacaaagagatgattanaaagactnactagtactctgacaaaatgaaacacgacctaagaaaacccggaggaacaacgggtccgtagttattaacgttgtacgggtaagaaacaaaaggtagtggaatggtgggtacggtagcgtaggtacg

SEQ ID NO: 361233 - DNA, 598 bp, Homo sapiens
  misc_feature: GZ8MTXP02IHYG7.21.4.A04.1.454.CMB.2.raw
  modified_base (294)..(294): a, c, t, g, unknown or other
  modified_base (310)..(310): a, c, t, g, unknown or other
  modified_base (438)..(438): a, c, t, g, unknown or other
  modified_base (457)..(457): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagacttggtccagcctgggacgggtccctgagacctctcctgtgcagcctctgcattccaccttcagtgaccaacaacngtcggactcgggtccnccgaggctaccggaggggaacggggctgggaggtggggtccggaccgttaagtaacgaaggaaacgctaaacgagttacagtacagagtcggcgtcgtctggtaggaaaggtagtcacatcacgaagngatgattaacaaagtactnactgtactctagacaatagaaacagacctaaagaaaacccggaggaaccgacggtcgttagttaagttagttagggtaggtaaagaacgtaaaaaggtggtaggaagttggtaggggtcgtaagtcgttaggtcgtaaccg

SEQ ID NO: 361234 - DNA, 706 bp, Homo sapiens
  misc_feature: GZ8MTXP02FI5LW.21.4.A04.1.454.CMB.2.raw
  modified_base (288)..(288): a, c, t, g, unknown or other
  modified_base (305)..(305): a, c, t, g, unknown or other
  modified_base (361)..(361): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggacgggtccctgagactctcctgtgcagcctctgcattcaccttcagtcgaccanaacatggactgggtccncaggctccgaggggagggctgggaggtgggtcgccgtatacgaaggaagctaaacngttacagtaacagaaacgtacgggctacgtctaggtaagggaaaagggtaacggttccaaaccgtagttactacgaaaagtagataggtaaactttacgaaaaaacgtaaccttcaaacgttagttaactaccgttaggaaacctaaaagttaccggaaaaccgtacggaaccccgttaaacgggaaaaaaaccccggacggggaaacccgaaacccgggggtcccgtttaaaggttacgttttaaacgtttaggggtaacgggttaaaacgaaaaccggtaaaaaagggtaggtaagggtaacgttggggtacggggttagggtaagtccgtagggttaacccg

SEQ ID NO: 361235 - DNA, 590 bp, Homo sapiens
  misc_feature: GZ8MTXP02F1VAL.21.4.A04.1.454.CMB.2.raw
  modified_base (304)..(304): a, c, t, g, unknown or other
  modified_base (356)..(356): a, c, t, g, unknown or other
  modified_base (378)..(378): a, c, t, g, unknown or other
  modified_base (416)..(416): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctggagggtccctgagactctcctgtgcagcctctgcattcaccttcagtcgaccacaacatggactggggtccnccgaggctccgaggggaagggctggaggtgggtcggcgtatacgaaggaaanctaacagttacagtacagaaanacggcgcgtctagtaggaaaggtaggttcaaccatacncgaaagtagatagattacaaaagactacactgtactctagacaaatcgaaacacgacctaagaaaacccggaggaaccgacggtaccggttagttaatttagttaggtagggtaacgaaaacgtaaaaggtaggtaagggaagttgggttacgggtggtaagccgtaggtaacg

SEQ ID NO: 361236 - DNA, 628 bp, Homo sapiens
  misc_feature: GZ8MTXP02HUE9P.21.4.A04.1.454.CMB.2.raw
  modified_base (581)..(581): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctggacgggtccctgagactctcctgtgcagcctctgcattcaccttcagtgaccacaacatggactcggggtccgccaggcctccgaggggaggggctagggaggtggggtcggaccgtagttaacgaacgggaaagcctaaacagttacaagttacagaatacggcgcgtctggtagaaagggaagttcaacccatctacaaagagatagaattacgaaaagtaactacgaacttagtattctagacgaaaagtacgaaaccacgaaccgtaaggaaaaaccgagggaaaccgacgggtaccgttaggttaagtttaacgttaggttaagggtaactaaacgaaaaaggnggttaagggaagtgggttaggggtaggtaagtccggtttagtaacgg

SEQ ID NO: 361237 - DNA, 614 bp, Homo sapiens
  misc_feature: GZ8MTXP02G2FB0.21.4.A04.1.454.CMB.2.raw
  modified_base (387)..(387): a, c, t, g, unknown or other
  modified_base (402)..(402): a, c, t, g, unknown or other
  modified_base (424)..(424): a, c, t, g, unknown or other
  modified_base (433)..(433): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccatcggagaaattgtgttgacgcagtctccaggcaccctgtctttgtctccgaggggaaagagccaccctctcctgcagctccagccagaatatccagagctactacatacgcctggtaccagcagaagcctgggcccaggcctcccgaggtttccctcatctatgcctcgggtacccacgacgggccacgtcggcacgtccccagaccctagggttacagtgggctaggtggggtctggggacngtaccttcacgttcncatctatagcagtacgtggacncgtgaagtntttcgactagttcgttattactgtacagctaaggttagtaggtaacgttccgtaccttcgttcgggttaccgttaccgggaccgtaaaacggggtaccgtaaaagggtaaacggtaaaacgttacggaaaaacggtaacgttacgggtaacggtacgttacggactaaccgtatttacccg

SEQ ID NO: 361238 - DNA, 836 bp, Homo sapiens
  misc_feature: GZ8MTXP02JPQHI.21.4.A04.1.454.CMB.2.raw
  modified_base (325)..(325): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccaggccgtgggacgggtccctggacgacctctcctgtgcagtcctctgctacttccaccttcgagtcgaacccaacaacgagtcgggactcggggtcccnccgaggtcctaccggaagggggaacggggtccgtggggacggttcgggggtaccggtacccgttaaagttaaccgaaaaggggtaaaacgtccttaaaacgtacggtttaaaccaaggttaaccgaaggtaaacgttaccgggggcgtaccgttacgtagggtaaacggaaaacggggtaacggttccaaacccgtataccgttaagaaaaggtagtaacgtaaggtaaactttaaccgaaaaacgttacccttacgaccgtttagttaaccttccgtaaacggtaaccctaaaaagttaccggaaaaccgtacggtaaaccccgtaaaacggggaaaaaacccccggggtcgggtaaaccccgtaaccggggttacgtttaaaggtttaaacgtttaacgggttaacgggttaaacgggtaaaacgaaaacggttaaaagggtacgggttaaggggtaacggtttacgggggttacggggttacggtacggtaccggtttacggtaaccg

SEQ ID NO: 361239 - DNA, 590 bp, Homo sapiens
  misc_feature: GZ8MTXP02GI780.21.4.A04.1.454.CMB.2.raw
  modified_base (310)..(310): a, c, t, g, unknown or other
  modified_base (364)..(364): a, c, t, g, unknown or other
  modified_base (384)..(384): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggtccctgagactctcctgtgcagcctctgcattcaccttcagtcgaaccacaacatggactcggggtcccnccgaggcctccgaggggagggctgggaggtgggtcggccgtatacgaaggaaanctaacagttacagtacaganacggcgcgtctaggagaaagggacgttcacctatctacgaaagagatagaattaacaaagaactcaactgttatctagacaaaatcgaaacacgtacctaagaaaacccggagaaaccacgggccgttagtaaatttaggtaggttaacggaagaaacgtaaaaggtgtaaggtaaggtggttcggggagtaaggcttaggtaacg

SEQ ID NO: 361240 - DNA, 626 bp, Homo sapiens
  misc_feature: GZ8MTXP02IPS5P.21.4.A04.1.454.CMB.2.raw
  modified_base (281)..(281): a, c, t, g, unknown or other
  modified_base (291)..(291): a, c, t, g, unknown or other
  modified_base (308)..(308): a, c, t, g, unknown or other
  modified_base (350)..(350): a, c, t, g, unknown or other
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgtttggtccagccctgggagggtcccctgagactctcctgtgcagcctctgcattcaccttnagtgacccanaacatggactgggtccnccaggctcgagggagggctggagtggcgcgtatacaaggaanctaacngttacaggtacagaatcggcgtcgtcgtgtaggaaaggaagttcaaccgtatctacgaaagagatagaattacaaaagaacttacacttagtaattctagactaaaaatcgaaaacaacgaccgtaaacggaaaaacccgggacgggaaaccgaaccggggtacccgttaggttaaatttaagttagggtacgggttaaacgaaaacgtaaaaaggtaggtaagggtaaacgttggggtagggtagggtacgtacggtttaggtaaccgg

SEQ ID NO: 361241 - DNA, 549 bp, Homo sapiens
  misc_feature: GZ8MTXP02ILMI1.21.4.A04.1.454.CMB.2.raw
  modified_base (199)..(199): a, c, t, g, unknown or other
  modified_base (292)..(292): a, c, t, g, unknown or other
  modified_base (379)..(379): a, c, t, g, unknown or other
tcagtcgtcgctcgcacgaccggtgctcgatttagagtagtgatcaggggagagctgctcagttaggacccagagggaaccatggaaccccagcgcagcttctcttcctcctgctactctggctcccaggctcagaaaccaccggagaaattgtgttgacgcagtctccaggcaccctgtctttgtctccaggggaaangccacctctcctgcagctccagcccagaatactccagagctactacatacgcctggtaccagcagaagcctggccaggcctcccaggttcccncatctatgcctcgggtcccagcgggcccacgtggcactccccagactaggttcagtggcagtgggtctggggacagtccttcactcncatctatagcagacgtggagcctagaagtagttcgcgtagttgttaattacgtgtcagctagtagtaggtaagttcaccttgtcgttcgttcggaccgtaaaggaccgtaaaggtaaagaaacgtaacggaaacgtaacgtggtcggtacgtcgacacctactcgttacg

SEQ ID NO: 361242 - DNA, 690 bp, Homo sapiens
  misc_feature: GZ8MTXP02JTMPB.21.4.A04.1.454.CMB.2.raw
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtcgaccaacaacagtggacgtcgggtaccgccaggcctaccggaaggggaaggggctagggaggtggggtccggaccgtattaacgaaaggaaacgctaaacgagtttaacagtaccaagacgtacgggcgcgtcgtagtagaaaagggtaacggttccaacccgtaatcctaacgaaaggaagtagtagtaacttaacgaaaaacgtaactactaacgttaggttaactcgttagaactaaaacgtggaaaacccacggttacccgaaaacggaaaaacccgggacggaaaccgaacccggggtaccgttacggtttaaatttacggtacgggtaaacgggttaaagaaaacgtaaaaaggtggttaagggtaagtcgggttaggggtacggtagtcgtaaggtacgaaccg

SEQ ID NO: 361243 - DNA, 598 bp, Homo sapiens
  misc_feature: GZ8MTXP02JA779.21.4.A04.1.454.CMB.2.raw
  modified_base (308)..(308): a, c, t, g, unknown or other
  modified_base (359)..(359): a, c, t, g, unknown or other
  modified_base (478)..(478): a, c, t, g, unknown or other
  modified_base (565)..(565): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtccctgagactctcctgtgcagcctctgcattcaccttcagtcgaccacaacagtggactggggtcccnccaggcctccgaggggagggctggaggtgggtcgccgtatacgaaggaaanctaaacagttacaagtacagaagtacggcgcgtcgtaggtaggaaaagggaggttccaaacccgtatcctaacgaaagagtataggaattaacgaaaaagtactacaaacttgtaactntagactaaaagtcgaaaccagaccctaaagaaaacccggaggaccaacggtccgtagtattaacgttggaggtagaaaacaaaaggngtaaggaattggtacgggtagtagctaggtacg

SEQ ID NO: 361244 - DNA, 709 bp, Homo sapiens
  misc_feature: GZ8MTXP02F6712.21.4.A04.1.454.CMB.2.raw
  modified_base (315)..(315): a, c, t, g, unknown or other
  modified_base (503)..(503): a, c, t, g, unknown or other
  modified_base (548)..(548): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccagccgtgggacgggtccctgagactctcctgtgcagcctctgctattccaccttcagtcgaaccacaacagtggacctggggtcccnccgagggcctccggaagggggaaggggcgtggggagggttcggggtccgggtaccgtaagttaacgaaacgggtaaacgacctaaaacgtacgttaacgaagttaacgaggtaaacgtaccggggcgtaccgttcgtaggtagggaaaacggttacgggttcccaaacccgtatcctaacgaaagagnttaaggaacttacgaaaaagtacctcgaacttagtaactcgtaanaactaaacgtacgaaacctacggaaccgtaaaacggaaacccggaggtacgtacccggtacgttaagtttaatttaggtacggtaaaggtaaaacgaaaacggtaaaaggtaggtaagggtagttaggggttacgggttaggtaacgtacggttggtaacg

SEQ ID NO: 361245 - DNA, 599 bp, Homo sapiens
  misc_feature: GZ8MTXP02I6UIL.21.4.A04.1.454.CMB.2.raw
  modified_base (356)..(356): a, c, t, g, unknown or other
  modified_base (361)..(361): a, c, t, g, unknown or other
  modified_base (383)..(383): a, c, t, g, unknown or other
  modified_base (414)..(414): a, c, t, g, unknown or other
  modified_base (419)..(419): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgacccacaacatggactgggtcccgccaggcctccgaggggagggctgggaggtgggtcgccgtatacgaaggaanctaanagttacagtacagaatacggcncgtctaggtagaaagggagttcaccatctanaaagngatgaattacaaaagactacgacttgtaatctagacaaaagtgaaactagacccgtaaagaaaaccggaggaaccgacgggtaccgttagttaatttacgttagggacggttaaagaaaacgtaaaaggtaggttaagggaaagttgggttacggggtaggtaagtccgttaggtaacgg

SEQ ID NO: 361246 - DNA, 553 bp, Homo sapiens
  misc_feature: GZ8MTXP02H1IWC.21.4.A04.1.454.CMB.2.raw
  modified_base (305)..(305): a, c, t, g, unknown or other
  modified_base (389)..(389): a, c, t, g, unknown or other
  modified_base (522)..(522): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctgagactctcctgtgcagcctctgcattcaccttcagtgaccacaacatggactggggtccnccgaggctccgaggggaaggggctgggaggtggggtcggccgtattacgaaggaagctaacagttacagttacagaatacggcncgtctggtagaaaggagttcaccatctacaagagatgtaatacaaaagaactcaacttgtatctagacaaatcgaacagaccgtagaaaaccgagacgacggcgttagtattatgtaggtaacaacaaaaggngtaaggagtgtggtacggtagcgttagtacg

SEQ ID NO: 361247 - DNA, 611 bp, Homo sapiens
  misc_feature: GZ8MTXP02H9U1B.21.4.A04.1.454.CMB.2.raw
  modified_base (217)..(217): a, c, t, g, unknown or other
  modified_base (307)..(307): a, c, t, g, unknown or other
  modified_base (353)..(353): a, c, t, g, unknown or other
  modified_base (413)..(413): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggganacttggtccagcctgggagggtccctgagactctcctgtgcagcctctgcattcaccttcagtcgaccacaacagtggactcggggtccnccaggctccgaggggagggctggagtgggcgccgtatacaaggaanctaacaggttacagtacagaaactcggcgtcgtctggagaaaggacgttcaacctatcanaagtagatgaatacaaagactacactagtaacttcagactaaaagtcgaaacgacgtcccgaaaggaaaaacccggaggttaaacccgaaacgggtccgttagtttaactttacgttagggtaaggtaaacgaaaacgtaaaaaggaggttaagggagttagggttaccggggtagggtacgtcgttacggtaaacgg

SEQ ID NO: 361248 - DNA, 744 bp, Homo sapiens
  misc_feature: GZ8MTXP02FK5O7.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcggtgggggagtacgttcggtccgagccgtggggacgggttccctaggacgtacctcctccgtggtcgcacgtcccttcgtcgcctacttacctaccttcgagtacgaacccaacaacagtacggacgtcggggtcccgaccgacggtccgtaccggaagggggaacggggtcgtaggggtaggggttcggggtaccggtaccgttaaacgttaacggaaaaggggaaaacgtacctaaaacgtaacgttaacaacgttaacgaggaaacgtacgggcgtacgtcgtaggaaaggaaaagggtacgttaccaaaccgtatacctagaaagagtagtagtaaacttaacgaaaaacgtaccttacgacgttagttactcgtaagaactaaaagtaccggaaaacacggtaacccgtaaaacgggaaaaaccccggaggaaacccgaccgggtacgttaagttaaagtttagtagggtaacggtaaacgaaaaacgaaaggtaggtgtagtgggtacgggtagtacgtcgtagtaacg

SEQ ID NO: 361249 - DNA, 599 bp, Homo sapiens
  misc_feature: GZ8MTXP02GDSHE.21.4.A04.1.454.CMB.2.raw
  modified_base (420)..(420): a, c, t, g, unknown or other
  modified_base (492)..(492): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggtccctgagactctcctgtgcagccctctgctattccaccttcagtcgacccacaacatggactggggtcccgccaggcctccgaggggaagggctggagtgggtcgcgtatacgaaggaagctaacgagttacagtacagaatacggcgcgtctggtagaaagggagttcaaccatctanaagagatagattacgaaaagactacactgtatctagacaaatcgaaacagtacccgtaaaggaaaacccggnggaaaccgaaccgggtccgttagttaaagtttacgttggtaagggtaaacgaaacgtaaaaggtggtaagggaattagggtagggtacggtaagtccgtaggtaacg

SEQ ID NO: 361250 - DNA, 613 bp, Homo sapiens
  misc_feature: GZ8MTXP02I8QKZ.21.4.A04.1.454.CMB.2.raw
  modified_base (209)..(209): a, c, t, g, unknown or other
  modified_base (239)..(239): a, c, t, g, unknown or other
  modified_base (267)..(267): a, c, t, g, unknown or other
  modified_base (291)..(291): a, c, t, g, unknown or other
  modified_base (357)..(357): a, c, t, g, unknown or other
tcagtcgtcgctcgcacgaccggtgctcgatttagagtagtgatcaggggagctctgagagcggagccccagccccagaattcccaggtgttttcattttggtgatcagcactgaacacagaggactcaccatggagtttgggctgagcgtggtttctgtagttatttacaagtgtcagtgtgaggtgcagctggtgagtctggggganacttggtccagcctggaggtccctgagctntcctgtgcagcctctgcatcacttcagnacacaacatgactggtcgccagcnccgagggaaggggcgtggaggtgggtcggccgtagtacgaagaagacgacagttacagtacagaanaacggcgcgtgtgtaggaaaggaaaggttactaacccaaattcccgtaaacgaaagaagacgtagtaacgtaaacgtaaactaaactaacgtactacgtacgtacgtacgaacgtaaacgtaaacgaaacgaacgtaaacgtaaacggaaaaccggaaaccggaaacgtaacggtacgttacgttaagttacgttaggtaagtaaacgtaaacgaaagaaggtaagtagtaggtaggtaggtacgtacgtagtacg

SEQ ID NO: 361251 - DNA, 595 bp, Homo sapiens
  misc_feature: GZ8MTXP02HVT8L.21.4.A04.1.454.CMB.2.raw
  modified_base (305)..(305): a, c, t, g, unknown or other
  modified_base (556)..(556): a, c, t, g, unknown or other
tcagtcgtcgctcgcacgaccggtgctcgatttagagtagtgatcaggggagctctgagagcggagcccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatggactggggtccnccaggctccgaggggaggggctggagtggggcgccgtatacgaaggaaagctaaacgagttacagtacagaagtacggcgcgtctggtagaaaggaagttcaccatctacaagagatgaattacaaagaactcaacttgtaattctagactaaaatcgaaacagaccctaaggaaaaaccccggaggaaacccgaccgggtacccgttaggttaactttaaagttggtacgggttaaagaactaaaaaggngtaaggagttaggtagggtcggtaaggtcgttaggtacg

SEQ ID NO: 361252 - DNA, 589 bp, Homo sapiens
  misc_feature: GZ8MTXP02F74P8.21.4.A04.1.454.CMB.2.raw
  modified_base (217)..(217): a, c, t, g, unknown or other
  modified_base (305)..(305): a, c, t, g, unknown or other
  modified_base (380)..(380): a, c, t, g, unknown or other
  modified_base (474)..(474): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcaccttcagtcgaccacaacatggactgggtcccncaggctccgaggggagggctggagtgggtcgccgtatacgaaggaagctaaacagttacagtacagaatacggcncgtctaggtaggaaaggacgttcaaccgtatctacgaaagtagattagaacttacaaaagtacctacacgtgtactcgtagacaaatcgaaacngacctaaagaaaacccgaggaccaacgggtccgttagttacttagttaggtaggtaaagaaacgaaaaggtagtaagggaagttggggtcgggtagggtagtccgtgggtaaacg

SEQ ID NO: 361253 - DNA, 601 bp, Homo sapiens
  misc_feature: GZ8MTXP02HE16Q.21.4.A04.1.454.CMB.2.raw
  modified_base (276)..(276): a, c, t, g, unknown or other
  modified_base (303)..(303): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccctggagggtccctgagactctcctgtgcagcctctgcattcaccttnagtgaccacaacagtggactgggtccnccaggctcgagggaggggctggagtgggtcgccgtatacgaaggaagctaaacgagttacagtaacagaaacgtcgggctcgtctggaagaaacgggtaacggttcaacctatacgtacaaagtagatgaattaacaaaagtactacacttagaacttcctagaacaaaatgaaacacgacccgtaaagaaaacccggaggtaaccaacggggtaccgttaggttaattacgtttagggtaggttaaacgaaacgaaaagtaggtggaagtgggtacggtggtacggcgttaggaacg

SEQ ID NO: 361254 - DNA, 565 bp, Homo sapiens
  misc_feature: GZ8MTXP02JFLCV.21.4.A04.1.454.CMB.2.raw
  modified_base (216)..(216): a, c, t, g, unknown or other
  modified_base (304)..(304): a, c, t, g, unknown or other
  modified_base (392)..(392): a, c, t, g, unknown or other
  modified_base (422)..(422): a, c, t, g, unknown or other
  modified_base (427)..(427): a, c, t, g, unknown or other
  modified_base (469)..(469): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcaccttcagtgaaccaacaacatggactgggtccnccaggctccgaggggaacgggctgggagtgggtcggccgtaattaacaaaggaaagctaaacagttacagtaacagaaatacggccgngtctgtagaaaaggagttacaccaatcaanaaganatacgtaataacgaaacaaactacactagtatatagacaaanaagaaacaacgacgaacgaaacgaacgaacgaacgacgtagtatatagtagtagaaacgaaaagaagaagagtagtagtaggtagtacgtagtacg

SEQ ID NO: 361255 - DNA, 647 bp, Homo sapiens
  misc_feature: GZ8MTXP02H41AD.21.4.A04.1.454.CMB.2.raw
  modified_base (216)..(216): a, c, t, g, unknown or other
  modified_base (290)..(290): a, c, t, g, unknown or other
  modified_base (304)..(304): a, c, t, g, unknown or other
  modified_base (355)..(355): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtggagggtccctgagactctcctgtgcagcctctgcattcaccttcagtcgaccacaacntggactcgggtccnccgaggcctcgaggggagggctggagtgggcgcgtatacgaagaagctaanagttacagttacagaactacggcgtcgtactggtagaaagggtaacgttcaacctagtacctacgaaagaagatgaattaaccaaagtactacacgttagtacttcgacgaactaaaagtacgaaaaccacggtaacctaaacgggaaaaaaccccgggaggaaacccgtaaccgggtacgttaaaggtttaaactttacggttaacgggtaaacggtaaaacgaaaacgtaaaagggtcggttaaggtaagttacggggttacgggtacggttacggtcgttaacggtacg

SEQ ID NO: 361256 - DNA, 582 bp, Homo sapiens
  misc_feature: GZ8MTXP02JPK3L.21.4.A04.1.454.CMB.2.raw
  modified_base (263)..(263): a, c, t, g, unknown or other
  modified_base (305)..(305): a, c, t, g, unknown or other
  modified_base (353)..(353): a, c, t, g, unknown or other
  modified_base (379)..(379): a, c, t, g, unknown or other
  modified_base (413)..(413): a, c, t, g, unknown or other
  modified_base (550)..(550): a, c, t, g, unknown or other
tcagtcgtcgctcgcacgaccggtgctcgatttagagtagtgatcaggggagctctgagagcggagccccacgccccacgaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctntgcattcaccttcagtcgaccacaacatggactggggtcccnccaggctccgaggggaagggctggagtgggtcgcgtatacgaaggaanctaacagttacagtacagatacggcncgttgtagaaaggacgttcaccgatctacaaagngataggtaacttacgaaaagtactacacttagtactatagaacctaaaatcggaaaacacggtaccaaacggaaaaccggaggaccaaccggggtaccttaggtaatttagtgggtacggtaaagaacgtaaaaggngtggaattggtaggtcggtatcgtacgtaacg

SEQ ID NO: 361257 - DNA, 700 bp, Homo sapiens
  misc_feature: GZ8MTXP02GGVOV.21.4.A04.1.454.CMB.2.raw
  modified_base (298)..(298): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagccgtgggacgggtccctgacgactctcctgtgcagcctctgctattccaccttcagtcgaccaacaacngtggactcgggtcccgccgaggcctaccggagggggaacggggcgtggggaggttcggggtccggaccgttaagttaacggaaacgggtaaaacgcctaaaacgtacgtttaacaagttaacgagtaaagtaccgggcgtacgtacgtaggtaggaaaaggggtacgttccaaacccgtagtacctacgaaagtagattagaaattacaaaaagtacctacgaacttagtaacttcctaggaacaaaagtcgaaaaccgacgtaacccgaaaaggaaaaaccccggagggaccgtaaaccggtcgttaagttaagtttacgtagggttaaggtaaaacgaaaagtaaaaggtaggttaagtaacgttgggtacggggtaggtacgtacggtttaggaaccgg

SEQ ID NO: 361258 - DNA, 641 bp, Homo sapiens
  misc_feature: GZ8MTXP02IS0AM.21.4.A04.1.454.CMB.2.raw
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacttggtccagccgtgggagggtccctgagactctcctgtgcagcctctgctattcaccttcagtcgaaccacaacagtggactgggtcccncgaggctccgaggggagggctgggagtgggtccgcgtatacgaacggaaagctaaacgagttacagtacaggaatacgggcgtcgtcgtaggtaggaaaaggtagttcacccgtatcgtacaaaggagactagattaacaaaagaccttcaaacgttgtaaattcgtagactaaaagtcgaaacacggtaccctaaaaggaaaacccggaaggtacccgaaccggggttaccgttaggttaaatttacggtttgggtaagggttaaacgaaaactaaaagggtaggtaacggtaagttggggttacgggtagtacggtcctagggtaaccg

SEQ ID NO: 361259 - DNA, 597 bp, Homo sapiens
  misc_feature: GZ8MTXP02FULN4.21.4.A04.1.454.CMB.2.raw
  modified_base (358)..(358): a, c, t, g, unknown or other
  modified_base (392)..(392): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtgggggagacttggtccagccgtgggagggtccctgagactctcctgtgcagcctctgcattcaccttcagtcgaaccacaacatggacgtcgggtccgccaggctccgaggggagggctggaggtgggtcgcgtattacgaaggaanctaacagttacagtaacaggaatacgggcgcgtntaggtaggaaaagggtaagttccaacccgatcctagaaagagatagaattacgaaaagtactacactagtatcgtagacaaaatcgaaacacggacctaaacggaaaaccggaggaaaccgacgggtaccgtagttattagttaggtaggttaaacgaaacgaaaaggtagtaaggaagttggtagggtggtaacgcgtagtacg

SEQ ID NO: 361260 - DNA, 631 bp, Homo sapiens
  misc_feature: GZ8MTXP02HVTLL.21.4.A04.1.454.CMB.2.raw
  modified_base (395)..(395): a, c, t, g, unknown or other
  modified_base (400)..(400): a, c, t, g, unknown or other
  modified_base (430)..(430): a, c, t, g, unknown or other
  modified_base (519)..(519): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggacgggtccctgagactctcctgtgcagcctctgcattcacctcagtgaccacaacatggactcgggtccgccaggcctaccggaggggaacggggcgtgggaggtcggggcggtaccgtagtaacgaaggaaagctaaacgagttacagtacagaatacggcncgttnaggtagaaagggtacgttacaacctatcanaaagtagatagaaacttacgaaaagacttactactattactctaggaaacctaaagtgaaaccgaacgtacctaaacggaaaaaccggngggaaacctacgggtaccgtttagttaaagtttaacgttaggtaaggttaaacgaaaacgtaaaaggtaggtgggtaagtaggttaggggagtttaacgcggtttagtaacg

SEQ ID NO: 361261 - DNA, 798 bp, Homo sapiens
  misc_feature: GZ8MTXP02JIWLQ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggacgggtccctgagacctctcctgtgcagcctctgcattccaccttcagtcgaccaacaacagtggacctcggggtcccgccgaggcctaccggagggggaacggggtcgtggggacgggttcggggtccgggtacccgttaaagttaaccggaaaaggggaaaacgtccgttaaaaacgtaaggtttaacccgaaaggttaaaccgtaagggtaaaacgttaaccgggggccggtaccgttacggtagggttaaacgggaaaaacgggggttaaacggtttacccaaacccgtaagttccctaacggaaaaggtacgtaattacggtaaactttaacgaaaaaacggtacctttacgaccgtttaggttaacttaccgtaggtaaacctaaaaagtaccgaaaaccgacgtaacccccgtaaaacgggaaaaaaccccggagggtaaccccgtaccggggtacctttaggttaaactttagttacggggttacgggtaaaacgaaaacaaaagggtaggttggaacgttggggttacggggtagtaacgtcgtaggtaaccg

SEQ ID NO: 361262 - DNA, 726 bp, Homo sapiens
  misc_feature: GZ8MTXP02FPJV7.21.4.A04.1.454.CMB.2.raw
  modified_base (199)..(199): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcacctgtcttgtctccgaggggaancgccaccctctcctgcagctccagccaagaatactccagacgtctactacatacgcctaggtaccagcagaagcctgggcccaggtcctccccgaggttccctcatctatcggcctcggggtaccccacgacggggcccacgtcggaccactccccgaaggaccgtacgggtttccagggtcggacgtaggggttcggggttacgtgggggaacctacggtacctttaccgaaccgtttctacgtaacttacctaagtttacgacgtaacggtaccggttagggaacgtcccgttaggtaaacggttacgtttaccgacgttaagttagttaacgtttaccgtggtaccgaaggtacgtaacggttagttacgggtaaacgtttaccgtaccgttcgtttacggttacccggtttaccgggaaaccggtaaacgggaaaccggtaaaagggttaaacgtaaaacgttaacggaaaaccggttaacgtaaggttacggacgttacgacctaacgtacgttcgtttacg

SEQ ID NO: 361263 - DNA, 602 bp, Homo sapiens
  misc_feature: GZ8MTXP02HGYEA.21.4.A04.1.454.CMB.2.raw
  modified_base (264)..(264): a, c, t, g, unknown or other
  modified_base (277)..(277): a, c, t, g, unknown or other
  modified_base (352)..(352): a, c, t, g, unknown or other
  modified_base (423)..(423): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctntgcattcaccttnagtgaccacaacatggactgggtcccgcaggcctcgaggggagggctgggagtgggtcgccgtatacgaaggaanctaacagttacagtacagaatacggcgcgtctaggtagaaaagggtagttccaaccgtatcctagaaaganatagaattacaaaagactacacttagtacttcctagacaaaagtacgaaacacgacccgtaaggaaaaccccggagggaaacccaccggggtaccgttagttaaagtttacgttggtaagggtaaacgaacgaaaaaggtggtaaggagtagggtagggtaggtacgtcgttaggtacg

SEQ ID NO: 361264 - DNA, 582 bp, Homo sapiens
  misc_feature: GZ8MTXP02F0BIF.21.4.A04.1.454.CMB.2.raw
  modified_base (498)..(498): a, c, t, g, unknown or other
  modified_base (545)..(545): a, c, t, g, unknown or other
  modified_base (565)..(565): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtcccgcaggcctccgaggggaaggggctggaggtgggtcggcgtatacgaaggaaagctaaacagttacagtacagaatacggcgcgtctaggtagaaagggtaaagttccaacccatactacaaagagatagaattacaaaagacctacaactgtaactctagactaaaatcgaaacaggaccctaaggaaaaaccgnggaaccacggtccgtagtatttagtggtaggtaacgaaacgaaaagnggtaaggactggttacgggngttaacggcttagtacg

SEQ ID NO: 361265 - DNA, 649 bp, Homo sapiens
  misc_feature: GZ8MTXP02J1OCV.21.4.A04.1.454.CMB.2.raw
  modified_base (449)..(449): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtcccagcccgtgggacgggtccctgacgactctcctgtgcagcctctgcattccaccttcagtcgaccacaacagtggactgggtcccgccagggcctaccgaggggaacggggctgggaggtggggtccgccgtaatacgaaggaaagctaaacgagttacagtaacagaaatacggcgcgtctaggtagaaaagggaacgttccaaccctatcctaagaaagngtatgaaattaccaaaagtaactcgtaactagtactcgtagacctaaaagtcgaaaacaacggacccttaaaggaaaaaccccggagggaaccccgaacggggtccgttagtaaagttacgttaagggacggttaaaagaaaaccgtaaaaggtaggtgggtaagtacggggtggttaggtaccgtacgttgggtaaccg

SEQ ID NO: 361266 - DNA, 607 bp, Homo sapiens
  misc_feature: GZ8MTXP02IXQNA.21.4.A04.1.454.CMB.2.raw
  modified_base (276)..(276): a, c, t, g, unknown or other
  modified_base (286)..(286): a, c, t, g, unknown or other
  modified_base (303)..(303): a, c, t, g, unknown or other
  modified_base (348)..(348): a, c, t, g, unknown or other
  modified_base (353)..(353): a, c, t, g, unknown or other
  modified_base (422)..(422): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagctctcctgtgcagcctctgcattcaccttnagtcgaccanaacatggactgggtccncaggctcgaggggagggctggagtgggtcgcgtatacgaaggaanctaanagttacagtaacagaatacgggcgcgttcgtaggtaggaaaagggtaacggttccaaccgtatacgtanaaagtagatagaacttacgaaaaagaccttacaacgttagtaacttcgtaagacaaaagtacgaaacacgtacctaaacggaaaaccggaggaaccacgggtaccgttagtaatttacgttgggagttaaacgaaaactaaaggtaggttaaggagttggtacgggtaggtacgcgttaggtacg

SEQ ID NO: 361267 - DNA, 556 bp, Homo sapiens
  misc_feature: GZ8MTXP02HZGAC.21.4.A04.1.454.CMB.2.raw
  modified_base (524)..(524): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggggagacttggtccagcctgggagggtccctgagactctcctgtgcagccctctgcattcaccttcagtgaccacaacatggactggggtcccgccaggctccgaggggagggctggagtgggcgcgtatacaaggaaagctaacagttacagtacagaaatacggcgagtctagtagaaaagggtaagttccaaccgattcacaagagatgaattacaaaagtaaactcacttagtaacttcagacaaatgaaacagacccaagaaaacccgaggacaacggtctagtaattatggagtaagaaacaaaagngttaaggaattggaggtacgtagcgttagacg

SEQ ID NO: 361268 - DNA, 597 bp, Homo sapiens
  misc_feature: GZ8MTXP02IX5KW.21.4.A04.1.454.CMB.2.raw
  modified_base (200)..(200): a, c, t, g, unknown or other
  modified_base (208)..(208): a, c, t, g, unknown or other
  modified_base (290)..(290): a, c, t, g, unknown or other
  modified_base (421)..(421): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggaangccacctntcctgcagctccagccagaatatccagagctactacatagcctggtaccagcagaagcctggccaggcctcccaggttcccnatctatcgcttgggtccccacgagggcccacgtggctaactccccagacctaggttccagtggcaggtggtctggggacaggtacttccactctacatcattagcagactgagctgaagatttcgctagtnttattactgtctaggactagtataggtaaacgttctaaccttcgtcgttcggtttacgggtacccgaaaacgggttacccgaaaacggttaaacggtaaagttaacggaaaacgtaaaccggttaaggttacgggaaccgtttcggaacgtaaccccgtaagtttaccctttacgg

SEQ ID NO: 361269 - DNA, 651 bp, Homo sapiens
  misc_feature: GZ8MTXP02IKOJ4.21.4.A04.1.454.CMB.2.raw
  modified_base (528)..(528): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctctgcattccaccttcagtcgaaccacaacagtggactggggtcccgccgaggcctccgaggggaacggggcgtgggaggtcggggtccggccgtaattacgaaaggaagctaacagttacagtacagatacggcgcgtctaggtagaaagggtacgttcaaccgtatcgtacaaagtagatagtaacttaacaaaagtactcaaacgttgtaacttctaggaactaaaagtcgaaacctacgacccgtaaaaggaaaaacccggngggaaaccgaccggggtacctttaggttaaatttaggtttaggtaagggtaaaacgaaaaccgaaaaaggttaggtaaggggtaacgttgggggttacgggtagggtaagtccgttaggtacg

SEQ ID NO: 361270 - DNA, 634 bp, Homo sapiens
  misc_feature: GZ8MTXP02JJ15D.21.4.A04.1.454.CMB.2.raw
  modified_base (311)..(311): a, c, t, g, unknown or other
  modified_base (419)..(419): a, c, t, g, unknown or other
  modified_base (451)..(451): a, c, t, g, unknown or other
tcagtcgtcgctcgcacgaccggtgctcgatttagagtagtgatcaggggagctctgagagcggagccccagccccagaattcccaggtgttttcatttggtgatcagcacctgaacacagaggactcaccatggagtttgggctgagctgggttttccttgttgttattttacaaggtgtccagtgtgaggtgcagctggtggagtcgtgggggagacttgggtccagccgtgggagggtccctgagactctcctgtgcagcctctgcattcgaccttcagtcggcccacaacagtggactggggtaccnccgaaggcctccgaaggggaacggggctaggggaggttcggggtcgggtaccgtaagttaacgaaagggtaaagccttaaacgagttacaggtacagaactacgggcncgtctggagaaaaggagttcaaccgatcctanaaagagatgaattacaaaagtaactcaacgttgtaatccgtagaactaaaagtgaaaacctagtcccgtaaagaaaacccggaggaaccgacgggtaccgtaggttactttaaagtgggtaaggtaaacgaacgtaaaaggagtaaggggaacttggtggggttagaaggctttagggtaacg

SEQ ID NO: 361271 - DNA, 605 bp, Homo sapiens
  misc_feature: GZ8MTXP02FL9BQ.21.4.A04.1.454.CMB.2.raw
  modified_base (263)..(263): a, c, t, g, unknown or other
  modified_base (324)..(324): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctntgcattcaccttcagtcgaccacaacatggactgggtcccgcaggcctcgaggggagggcnggagtggcggacgtatacgaaggaagctaagagttacagttacaggtaatacggcgtacgtcgtagtaggaaagggagttacaaccgtatacgtacaaagtagatagaattacaaagactacactgtaatcctagactaaaatcgaaacacggtaccgtaaacggaaaacccgagggaacccaacgggtcccgttaggttaacgtttaaagttcgggtaacggttaaagaaacgaaaaggtagtaaggaagttggtacgggtaggtaagcgtagtaaccgg

SEQ ID NO: 361272 - DNA, 732 bp, Homo sapiens
  misc_feature: GZ8MTXP02FSJRO.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctctgctatcaccttcagtcgaaccacaacagtggactcggggtcccgaccgaggcctaccggaagggggaacggggccgtaggggagggttcggggtaccggaccgttaagttaaccgaaaaggggtaaaacgccgtaaaaccgtaaggtttaaaccgaaggttaaaccgaagggtaaacgttaccgggggaccggtaccgttcgttagggtaaacgggaaaaagggtaacgggtttccaaacccgtataccctaacgaaaggtacgagttagaaatttaaccgaaaaaagtaccttaacaacgttaggttaactccgttaggaaacctaaaagtcgaaaacgacgtaccgaaacggaaaacccggaggaccgaaccgggtaccgttagttaaagtttagttacggtaaggtaaacgaaaacgaaaaggtggtaaggagttagggtcggtagtaacgtcgtaggtaaccg

SEQ ID NO: 361273 - DNA, 636 bp, Homo sapiens
  misc_feature: GZ8MTXP02ION6U.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacagtggactcggggtccgccgaggcctccgaaggggaaggggcgtagggaggtggggtcggccgtattacgaaaggaagctaaacagtacaagtacagaagtacggcgcgtcgtagaggaaaggagttcacctatctacaaagagatagaacttacaaaagaactacaagttgtaacttcagacaaaattagaaaccaacgtacctaaaacggaaaaacccgacgggaaaccgtaacccgggtacgtagtttaacgtttaacgttagggtacgggttaaaagaaaacgtaaaaagggtggttaaagggagttaggggtacgggtagggttaacgtcggtttaggtaacg

SEQ ID NO: 361274 - DNA, 632 bp, Homo sapiens
  misc_feature: GZ8MTXP02F12D3.21.4.A04.1.454.CMB.2.raw
  modified_base (312)..(312): a, c, t, g, unknown or other
  modified_base (408)..(408): a, c, t, g, unknown or other
  modified_base (440)..(440): a, c, t, g, unknown or other
  modified_base (527)..(527): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggttccctgagactctcctgtgcagcctctgctattcaccttcagtcgaccacaacagtcggactggggtcccnccgaggcctccgaggggaaggggctggggaggtgggtccggacgtaagttaacgaaaggaaacgctaaacagttaacaagttaacagaagtacggncgtgtagtagaaagggagttcaaccatccganaaagagatagaattacgaaaacgtactacaacttgtaactcgtagaacaaaagtacgaaacgacgtacccgtaaaggaaaacccggngggaaccaacggggtccgtaagttatttaacgttggaaggttaacgaaaacgtaaaaggtggtaagggtaaagttcggttacgggtaggtacggcgttaggtacg

SEQ ID NO: 361275 - DNA, 678 bp, Homo sapiens
  misc_feature: GZ8MTXP02IYU1B.21.4.A04.1.454.CMB.2.raw
  modified_base (292)..(292): a, c, t, g, unknown or other
  modified_base (309)..(309): a, c, t, g, unknown or other
  modified_base (392)..(392): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagccgtgggacgggtccctgagactctctgtgcagcctctgctattccaccttcagtcaaccacaacngtggactcggggtcccnccgaggccctaccggaaggggaacggggctaggggacggttcggggtaccggtacccgtaagttaaaccgaaagggtaaaacncctaaaacgtagttaacaaggttaacaggtaaagtaccggcgtacgtacgtaggtaaaggaaaagggtacgttcaaaccctatactaacgaaagagtagttagaaacttaaccgaaaataaccttactaacgttagtaacttcgtagaactaaaatacgaaacctacgaccgtaaaacggaaaaccgaggaaccgaccggtacgttagttaaagtttagtacggtaaaggtaacgaaaacgtaaaaggtagtaaggtaagtggtaggtacgtacgtcgttacgacg

SEQ ID NO: 361276 - DNA, 553 bp, Homo sapiens
  misc_feature: GZ8MTXP02JH01D.21.4.A04.1.454.CMB.2.raw
  modified_base (355)..(355): a, c, t, g, unknown or other
  modified_base (418)..(418): a, c, t, g, unknown or other
  modified_base (424)..(424): a, c, t, g, unknown or other
  modified_base (512)..(512): a, c, t, g, unknown or other
  modified_base (522)..(522): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctgagactctcctgtgcagcctctgcattccaccttcagtcgaccacaacatggactggggtcccgccaggctccgaggggagggctgggagtgggtcgccgtatacaaggaanctaacagttacagtacagaactacgggcgcgtctaggtagaaagggtacgttccaccatctanaaaganatgaattacaaaagactcactgtatcagacaaatgaacagacctaaggaaaacccgaggacacgggtcgtagtattagtgtaggtaanaaacgaaagngtaaggattagggtggtgtacgcgtaggtac

SEQ ID NO: 361277 - DNA, 786 bp, Homo sapiens
  misc_feature: GZ8MTXP02GKOJI.21.4.A04.1.454.CMB.2.raw
  modified_base (314)..(314): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgacgactctcctgtgcagcctctgctattccaccttcagtcgaccaacaacagtggactcggggtcccnccaggcctccgaggggagggctgggaggtcgggtcggacgtagtacgaaggaacgctaaacgagttacagtaacaggaaactacgggcgtcgtcgtaggtaaggaaaagggtaacgttccaaacccgtattaccgtacgaaaaggtagtattaggtaaactttaaaccgaaaaagtaacccttaccgtaaacgttaggttaaacttcgtaacggtaacctaaaaagtccggaaaaacctaccgggtaaccccgttaaaacggggaaaaaaaccccggacggggtaaaaccccgtaacccgggggttacccggtttaaaggttttaaaccgtttaacgggtttacggggtaaacgggttaaaaacggtaaaaacccgtaaaaaaggggttcgggttaacgggggttaaacgtttacgggggtttacgggggttaagggttaaaccggttccggtttaacggggtttaaaccgg

SEQ ID NO: 361278 - DNA, 655 bp, Homo sapiens
  misc_feature: GZ8MTXP02GQQBG.21.4.A04.1.454.CMB.2.raw
  modified_base (528)..(528): a, c, t, g, unknown or other
  modified_base (546)..(546): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcacgcctctgctactcaccttcaggtcaaccacaacagtggacgtcgggtccgccgacggccgtaccggaaggggaacggggcgtaggggacggtcggggtaccggtacgttaagtaacggaaaggaaacgtactaaacgtaagttacgaagtaacgaagacggtaccggcggtcgtacgtaggtaaggaaaacgggtacgttaccactatctaacgagagtatagaacttacaaagacctgacttgtatcgtagactaaatacaaacgngaaccaagggaaaaccgnggaaccgtacggcgttaagttaagtttagtaggtaggaaacgaaaagtaaaagggtgttagggtaagtcggggtttagggtacggtacgtacggtaggtaaccgtaacg

SEQ ID NO: 361279 - DNA, 649 bp, Homo sapiens
  misc_feature: GZ8MTXP02F16QS.21.4.A04.1.454.CMB.2.raw
  modified_base (266)..(266): a, c, t, g, unknown or other
  modified_base (283)..(283): a, c, t, g, unknown or other
  modified_base (306)..(306): a, c, t, g, unknown or other
  modified_base (328)..(328): a, c, t, g, unknown or other
  modified_base (357)..(357): a, c, t, g, unknown or other
  modified_base (363)..(363): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctntgcattcaccttcagtnaccacaacatggactcgggtccncgaggcctcgaggggacgggcnggaggtgggtcgcgtaatacgaaaggaanctaaanagttacagtaacagaacgtacggcgtccgtagtaggtaacgaaaagggtacggttaccaacccgtatcctaacgaaagtagtagtagtaattacgaaaaagacttaccgaacttagtaactctagaaccaaaagtacgaaaacgcgtaacccgaaaaggaaaacccggaaggaaccgaacccggggtacgtttaggttaaatttaaggttacggtaaggttaaacgaaaaacgtaaaaggtaggtaaggtagtacgggttggggtagttaaccgtggtagtaacgg

SEQ ID NO: 361280 - DNA, 681 bp, Homo sapiens
  misc_feature: GZ8MTXP02JVDK6.21.4.A04.1.454.CMB.2.raw
  modified_base (306)..(306): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacatcggactggggtcccnccgaggctccgaggggaggggctgggagtgggtcggccgtatacgaaggaagctaacgagttacagttacagaactacgggcgacgtctggtaggaaaagggtagttaccaacccgtatacgtacaaagagataggaactttacgaaaagtaacctactaacgttaggtacttacgtaggacctaaaagttacggaaaaccaacggtaacccgtaacgggaaaaaacccggagggaaaacccgaccggggtacccgtttagggtttaaactttaacgttacggggttagggttaaaacggaaaaccgtaaaaagggtacggttaagggtagttcggggttacgggggttaggtacggtaccgttggttaacccgg

SEQ ID NO: 361281 - DNA, 551 bp, Homo sapiens
  misc_feature: GZ8MTXP02JS07F.21.4.A04.1.454.CMB.2.raw
  modified_base (354)..(354): a, c, t, g, unknown or other
  modified_base (461)..(461): a, c, t, g, unknown or other
  modified_base (477)..(477): a, c, t, g, unknown or other
  modified_base (539)..(539): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactgggtccgccaggctccgaggggagggctgggagtgggcgcgtatacgaaggaagctaacngttaacagtacagagtacgggcgcgtctgtaggaaaggtaggttccaaccatctacaaagagatgaattacaaaagtactcaacttgtatctagacaaagtgaaacngacctagaaaacccgnggaccacgggcttagtattagtggagtaagaacaaaaggtgtaggaagtggtgggtaggtancgtggtacgaac

SEQ ID NO: 361282 - DNA, 588 bp, Homo sapiens
  misc_feature: GZ8MTXP02FWSB6.21.4.A04.1.454.CMB.2.raw
  modified_base (305)..(305): a, c, t, g, unknown or other
  modified_base (425)..(425): a, c, t, g, unknown or other
  modified_base (454)..(454): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctggagggtccctgagactctcctgtgcagcctctgcattcaccttcagtcgaccacaacatggactggggtcccnccaggctccgaggggaaggggctgggaggtgggtcggccgtatacgaaggaagctaaacagttacagtacagaaatacggcgcgtctaggtagaaaaggtaggttcaccatctcaaaganatgaattacaaaagactcaactgtaactntagacaaaagtcgaacagaccctaagaaaacccggaggaaccacgggaccttaggttaacttagtttaggtagggtaagtaaaacgaaaagaggtaagggaattgggtaggggtacggtaagtcgtaggtacgg

SEQ ID NO: 361283 - DNA, 739 bp, Homo sapiens
  misc_feature: GZ8MTXP02H0YUD.21.4.A04.1.454.CMB.2.raw
  modified_base (204)..(204): a, c, t, g, unknown or other
  modified_base (236)..(236): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcaagaaaccaccggagaaattgtgttgacgcagtctccaggcaccctgtctttgctccgaaggggaaancgccaccctctcctgcagctccagccagaatntcagagctaactacatacgcctaggtaccagacaagtaacgcctggccccaggcctccccgaggttccctcaattcctagtcgccgttggggaccccagacggggcccacggtggacctaaccgtccccgaaaggaccgtacggggtttaccaacgggttcggggacctaaggggtttcggggttaccgtacggggggtaaacctaagggttaaaccccttttccgaaaccttttcccgaaccgttaagttacccttaaagtttaaccggaccgtaaaggtaccggttacggggaacgtacccgtaaggtaaacgttagtttccgacttaaggttacgttaaactttacgttagtaccagtaccgtaagttacgtagttaaacgtcctaccttcgtcgttacggttacggaaccgtaaagggtaaaccgtaaagggtaaaacgaaaagtacggtaaaacgtacgtaaggtacgtacgtcgaacctacctaacgtttcgttacg

SEQ ID NO: 361284 - DNA, 694 bp, Homo sapiens
  misc_feature: GZ8MTXP02JNVR2.21.4.A04.1.454.CMB.2.raw
  modified_base (294)..(294): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgggcttgggtttccttgttgttattttacaaggtgtccagtgtgaggtgcagcgtggtggagtcgtgggggagacgttggtccgagccgtgggagggtccctgagactcctctgtgcacgcctctgctacttcaccttcagtcgacccanaaacagtggaccgtcgggccgccgaggcctccggaggggaacggggcgtgggagggtgggttcggacccgttaagttaacggaaggaaaccgtcgtaaacgacgttaacgagtaacagtagtacggacgtcgtactaggaagggaaaggtaacgggttaccaccgtactactacgaaaggtaagattaggaaactttaacgaaaacgtaaaccttctaaaccgttaggtaaactcgttaacgattaaaaactgaaaaccgagaacccgtaaggaaaaaccccgggaggtaacccgaaacgggtacccgttaggtaacgtttagttaacggtagggtaaagaaaaccgaaaaggtaggtaggaagttaggtaggggtagtaaccggtctaggtacggaacg

SEQ ID NO: 361285 - DNA, 521 bp, Homo sapiens
  misc_feature: GZ8MTXP02HS31C.21.4.A04.1.454.CMB.2.raw
  modified_base (202)..(202): a, c, t, g, unknown or other
  modified_base (297)..(297): a, c, t, g, unknown or other
  modified_base (373)..(373): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaaatatccagagctactacatagcctggtaccagcaagaagcctggcccaggctccccaggttcctnatctatgctgggtccccagagggcccactggcatccccagacacggttcagtgcaggtggctggggacagaccttnactctacatcattagcagactgagcctagaagtattcgcagttgttattactgtcagtcagtagtaggaagttcacctctgtcgttcggacaagggaactaaaggtaagaaacgtagaaaacgagtaagtggactcgacacctatctg

SEQ ID NO: 361286 - DNA, 700 bp, Homo sapiens
  misc_feature: GZ8MTXP02G9RUC.21.4.A04.1.454.CMB.2.raw
  modified_base (352)..(352): a, c, t, g, unknown or other
  modified_base (422)..(422): a, c, t, g, unknown or other
  modified_base (432)..(432): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcctgttgttatttacaaggtgtcagtgtgaggtgcagctggtggagtcgtgggggatacgttggtccagccgtgggacgggtccctgacgactctcctgtcgcagcctctgcattcaccttcagtcgaccacaacatggactgggtccgcaggcctcgaggggaggctggagtcgggtcgcgtatacgaaggaanctaagagtacagtacaggaactcgggacgcgtcgtaggtaagaaaagggtacgttccaaacctatccganaaaagggtanatagtaaataaacgaaaacgtacttacaacgttagttactacgtaaacgaacgtaaacgtaaacgtaaacgaacgtaaccgtaaaccggaaaaccggaaaccggaaaccggtaaccgggtaaccggttaacggtttaaacggtttaaacggtttaaacgggttaaacgggttaaaacggtaaaaacggtaaaaacggtaaaagggttaaagggtaacggttacggggttacggggttacggggttacgggttacggttacggtaacgg

SEQ ID NO: 361287 - DNA, 814 bp, Homo sapiens
  misc_feature: GZ8MTXP02HJ7AF.21.4.A04.1.454.CMB.2.raw
  modified_base (268)..(268): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagtacctctcctgtgcagcctntgctattccaccttcagtcgaaccacaacagtggactggggtcccaccgaggcctccggaaggggaaggggcgtaggggaggtcggggtaccggtaccgtaagttaacgaaaagggaaagtcctaaaacgagtttaaccaaggttaaccaggaaacgttaccggggcgtcgttacgtggtaaagggaaaaggggtaacgtttcaaacccgtattacctaacgaaaggtaagtagttaaggaactttaaacgaaaaaggtaaccttaccgtaaactttaggtaatttaccgtaggaacctaaaaataccgggaaaacctacgggtaaaccccgtaaaacgggaaaaaaccccggggacgggtaaaacccgaaccccgggggttacccgtttaaaagggtttaaactttttaaacggtttagggggttaaaaccggggttaaaagaaaaaccgggtaaaaaaaggggttgggttaacgggggtaagtttagggggtttaacgggggttacccggtttaaaggggtccgtttttaagggtaaaaccggg

SEQ ID NO: 361288 - DNA, 752 bp, Homo sapiens
  misc_feature: GZ8MTXP02I69ES.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtagttatttacaagtgtcagtgtgagtgcagctggtggagtctgggggagacttgggtccagcctgggagggtccctgagactctcctgtgcagcctctgcattcaccttcagtcgaccacaacagttcggactcggggtccccgacgacggtccgtacggaaggggaacgggtcgttagggacgggttcggggtccggtaccgttaaagttaaacggaaaacgggtaaacgtaccgttaaacgtaacggttaacaacggttaaacgacggtaaacggtaaccgggccggtaccggttacgttaacgggtaaagggtaaaacggggtaaacggtttaccaaaccgtaacgttaccgtaacgaaaggtaacgtactaaggtaaacttaaacgaaaacgtaacctacgtaagttacgttaaactacgtaacggtaaacctaaaacgtaacgaaaaccgaccggtaacccgtaaaacggaaaacccgggaagaacccgtaaccggtaccgtagttaaacgtttagttaacgggtaacgtaaacgaaaacgtaaaaggtaggtaagtagttaggtaggtaggtaccgtgtacgtacg

SEQ ID NO: 361289 - DNA, 670 bp, Homo sapiens
  misc_feature: GZ8MTXP02JD8E4.21.4.A04.1.454.CMB.2.raw
  modified_base (312)..(312): a, c, t, g, unknown or other
  modified_base (421)..(421): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgacgactctcctgtgcagcctctgcattccaccttcagtcgaacccacaacagtggactcggggtcccnccaggcctaccggaaggggaacggggctggggaggtcggggtccggacgtaagttaacgaaaggaaacgtcctaaacaggttacaagtaacagaacgtacgggcgcgtntaggtaaggaaacgggtaacgttccaactagtactaacgaaagagattagtaacttaacgaaaacgtactactaaacgttgtaacttgtacgaataaaagcgaaaacacgtaacccgaaacggaaaaacccggtgggaaacccgtaccggggtacgttagtttaaagttacgttaggtaaacgggtaacgaaaacgaaaaggtaggtccgggtaattcggggtagggtaggttacggtacgttacgacg

SEQ ID NO: 361290 - DNA, 619 bp, Homo sapiens
  misc_feature: GZ8MTXP02GU0BT.21.4.A04.1.454.CMB.2.raw
  modified_base (291)..(291): a, c, t, g, unknown or other
  modified_base (602)..(602): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgagactctcctgtgcagcccctgcattcaccttcagtgaccacaacntggactgggtccgccaggctccgaggggaaggggctgggagtggggtcgaccgtatacgaaggaacgctaaacagttaacagtaacagacgtacgggcgcgtactggtagaaaagggtaaggttccaacgatctacgaaagtagatgaattaacgaaaagaacctcaaacttgtaatcgtagacaaaagtacgaaacacgaccgtaacggaaaaaccgaggaaccgacggggtccgttaagttaacgtttagttacgggtaagggttaaagaaaccgaaaaaggtggtaggaagttggtagggtacggtanacggttggtacgaaccg

SEQ ID NO: 361291 - DNA, 746 bp, Homo sapiens
  misc_feature: GZ8MTXP02JPFPG.21.4.A04.1.454.CMB.2.raw
  modified_base (593)..(593): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacgttggtccagccgtgggacgggtccctgagactctcctgtgcagcctctgctacttcaccttcagtcgaaccacaacagtacgggacgtcggggtccccaccgacggcccgtaccggaagggggaacggggtcgtaggggacgggttcggggtaccgggtaccgttaaagttaaccggaaaacggggtaaacgtaccgttaaacgtaacgttaacgtaaggttaacgaggtaaaacgtaccggggccgtaccggttacgtaggtaaacgggaaaacggggtaccgtttaccaaacccgtagtacccgtaagaaaaggtagtacgtagtaaacttaaccgaaaagtaccttacgaacgtttagtaactccgtanaaccgtaaaagtacgaaacgtacgtacccaaaagggaaacccgtagggaaccctacccgggtacgttagttaaagtttacggttaggtaacggtaaagaaaaccgtaaaaggtggtaaggagtttgggtacggggtatacggtgtacgtaacg

SEQ ID NO: 361292 - DNA, 633 bp, Homo sapiens
  misc_feature: GZ8MTXP02F7GR3.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgagactctcctgtgcagcctctgcattccaccttcagtgaccacaaacatggactggggtcccgccgaggcctccgaaggggaacggggctgggaggtggggtccggccgtaattacgaaaggaaagactaaacgagttaacagtaacagaactacgggcgcgtcgtaggtaggaaaagggtaagttccaacctagtactacgaaagagaatgaattacgaaaaagactactactagtaactctagaactaaagtacgaaacacgtacctaaggaaaacccgaggaaaccgacgggtaccgttagtaaagtttagtggttacggtaaagaaaccgtaaaaaggtaggtaaggtaagttaggggtaggtagggtaagtcgttaggtaacgg

SEQ ID NO: 361293 - DNA, 720 bp, Homo sapiens
  misc_feature: GZ8MTXP02GQLHL.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgctattccaccttcagtcgaacccacaaacagtcggacgtcggggtcccgccgaggcctaccggaagggggaacggggcgtggggacggttggggtccggaccgttaagttaaccgaaagggaaacgacctaaacgagtttaacgaagttaacaggaaacgtaccgggcgtacgtacgtaggtaaggaaaagggtacgttcccaaaccctattccgtaacgaaaaggtagtataggtaaactttaaccgaaaaagtaccttacaacgttagttaactactacggaaactaaaagttacgaaaccacggtaccctaaaacgggaaaaacccggtagggaaaccgtacggggtttacgttagtttaaagtttacgtagggtaagggttaaacgaaaacgaaaaagggtggtaaggtaagttaggggttacggtaggtaacgtcgttaggtaaccg

SEQ ID NO: 361294 - DNA, 629 bp, Homo sapiens
  misc_feature: GZ8MTXP02H7H42.21.4.A04.1.454.CMB.2.raw
  modified_base (216)..(216): a, c, t, g, unknown or other
  modified_base (369)..(369): a, c, t, g, unknown or other
  modified_base (531)..(531): a, c, t, g, unknown or other
  modified_base (591)..(591): a, c, t, g, unknown or other
  modified_base (619)..(619): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagactctcctgtgcagcctctgcattcaccttcagtcgaccacaacagtggactcggggtccgccgaggctccgaaggggaggggcgtggaggtgggtcggccgtaagtacgaaggaaagctaaanagttacaggttacagaaagtacggcgtcgtcgtaggtagaaaacgggtaagttccaaaccctatcctagaaagaagtatagaacttaacgaaaagacttacaaacgtttgtaactttcaggaactaaaaagtcgaaaactagacctaaaacgggaaaaccgngggaacctaacccggggctaggttaaatttagttacggtaggtaaagaaacgtaaaaggngtaacggagttacggtgggtacggtacngttacggaac

SEQ ID NO: 361295 - DNA, 580 bp, Homo sapiens
  misc_feature: GZ8MTXP02JRKTR.21.4.A04.1.454.CMB.2.raw
  modified_base (303)..(303): a, c, t, g, unknown or other
  modified_base (353)..(353): a, c, t, g, unknown or other
  modified_base (384)..(384): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgacccacaacatggactggggtcccnccaggctccgaggggaagggctggagtggggtcgccgtagtacaaggaanctaaacagttacagtaacagaaatacgggcncgtactggtagaaaagggaaggttccaaccagtctacgaaagagatgaattacaaaagtactacacttagtatctagacaaaatgaaacacgacctaggaaaaacccggaggaaccacgggtccgtagtaagttagttaggtaggtaacaaacgaaaagtaggtaaggagtggtagggtggtacgtcgtagtacgg

SEQ ID NO: 361296 - DNA, 622 bp, Homo sapiens
  misc_feature: GZ8MTXP02FNQKA.21.4.A04.1.454.CMB.2.raw
  modified_base (306)..(306): a, c, t, g, unknown or other
  modified_base (511)..(511): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacagtggactggggtcccnccgaggcctccgaggggagggctgggaggtcgggcgccgtatacgaaggaagctaacagttacagtacagaactacggcgcgtctaggtaggaaaaggtacgttcaacccgatcctagaaagtagattagaacttaacgaaaagactacgaacgtagtactacgtagaactaaatcgaaacacgtaccgtaaacggaaaaccggnggaaaccgaccgggtaccgttagttaaagtttagttagggtaacggtaaagaaaacgaaaaggtaggtaagggtacgttagggtggggttaggtacgtcgttaggtaacgg

SEQ ID NO: 361297 - DNA, 820 bp, Homo sapiens
  misc_feature: GZ8MTXP02H1E79.21.4.A04.1.454.CMB.2.raw
  modified_base (261)..(261): a, c, t, g, unknown or other
  modified_base (292)..(292): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggacggtccctgagactctcctgtgcagcctntgctattccaccttcagtcgaacccacaacngtacggactcggggtcccgaccgacggcctaccggaaggggaacggggctaggggaggttcgggggtaccggtaccggtaaagtttaacggaaaacgggtaaaagtaccgttaaaacgaacggtttaacgaaggtttaaaccagggtaaaacgttaccggggaccggtaccgttaccgttagggtaaacgggtaaaacggggtaaacgggttaccaaacccgtagtaccgttaaacgaaaggtaagtaacgtaggtaactttaaacaaaacgtaaccttacgtaccgttagttaacttcgtaacggtaactaaaacgtacgaaaaccgtacggtaacccgtaaaacggaaaaaacccgggacggaaacccggtaaaccgggttaccggttaacggtttaaacgtttaaacggtttaaaggggtaaaggttaaacggaaaaaccgtaaaaaggggttagggttaacggtaacgggtttaacgggtttacgggggttaacggtagggttaccggtttaagggtaacccgg

SEQ ID NO: 361298 - DNA, 803 bp, Homo sapiens
  misc_feature: GZ8MTXP02HQTEV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtgaccacaacatggactggggtcccgccagggcctaccggaggggaacggggcgtaggggaggttggggtccggtaccgttaagttaaccggaaaggggaaacgaccttaaaacgacggtttaacaacggttaacagggtaaaacgtacgggggaccgtaccgggttacgtacgggttaaaggaaaacgggggtaaacgggtttcccaaacccgtaaattacccgtaacgaaaaggtaagtaattaggtaaacttaacgaaaaacgtaacttaccgaaactttggtaacttccgtagaaacctaaaagtacggaaaaccacggtaacccgtaaacgggaaaaaaccccgggtagggaaaaccccgtaacccggggtacccggtttaagggtttaaacttttaacggtttaaggggttaaacggggttaaaacggaaaaaccgttaaaaaggggtaggttaagggggtaagttaccgggggtttacgggggttaaccgggtacggtaccggtttaggtaacccgg

SEQ ID NO: 361299 - DNA, 513 bp, Homo sapiens
  misc_feature: GZ8MTXP02J5LGP.21.4.A04.1.454.CMB.2.raw
  modified_base (215)..(215): a, c, t, g, unknown or other
  modified_base (261)..(261): a, c, t, g, unknown or other
  modified_base (343)..(343): a, c, t, g, unknown or other
  modified_base (347)..(347): a, c, t, g, unknown or other
  modified_base (366)..(366): a, c, t, g, unknown or other
  modified_base (434)..(434): a, c, t, g, unknown or other
  modified_base (436)..(436): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagtctgggttttccttgttgttattttacaaggtgtccagtgtgaggtgcagctggtggagtctggggganacttggtccagcctggagggtcccctgagctctcctgtgcagcctntgcattcacttcagtgaccactacatggactcgggtccgcaggctcgaggaaggggctggagtggtcgcgtatacaggaacntacngtacagtacagatacggcncgtctgtagaaaggagttcaccatcgacaaggatatcgaattcgaaaagactcactgtatctgcaaananacgacgacgacgaacgacgacgacgcgtacgtatatagtagtagacgaagagagtaagtgtgtgtgtcgtcgtgtcg

SEQ ID NO: 361300 - DNA, 560 bp, Homo sapiens
  misc_feature: GZ8MTXP02GV1YH.21.4.A04.1.454.CMB.2.raw
  modified_base (303)..(303): a, c, t, g, unknown or other
  modified_base (417)..(417): a, c, t, g, unknown or other
  modified_base (446)..(446): a, c, t, g, unknown or other
  modified_base (472)..(472): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtcgaccacaacatggactcggggtccnccaggctccgaggggaaggggctgggagtgggtcggccgtaatacaaggaaagctaacagttacagtacagaatacggcacgtctggtagaaagggaagttcaaccgatcctanaaagagatagaattacgaaaacgtaactnaacttgtaatctagacaaatcgaaanagacctaagaaaccgaggacacggcgtagtattagtgtaggtagaacaaaaggngtaaggataggttgggtacgtacgcgtagtaacg

SEQ ID NO: 361301 - DNA, 646 bp, Homo sapiens
  misc_feature: GZ8MTXP02GY2FH.21.4.A04.1.454.CMB.2.raw
  modified_base (279)..(279): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtcccctgagactctcctgtgcagcctctgcattcaccttnagtcgaccacaacagtggactcggggtcccgcgacggcctaccggaggggaacggggcgtgggaggtcggggtcggtaccgtaagttacgaaagggaaacgctaaacgagttacagttaacaggaatacggcgacgtcgtggaaggaaaagggtacgttccaaccctaagtcctacgaaaagtacgtatagtaacttaaccgaaaaagtacctacacgttagtactctagaactaaagtaccgaactacgacctaaacggaaaaccgacgggtacaccgggtcttagttaatttagttaggtaggtaaacgaaacgtaaaaggaggttaaggaaacttggggtacgggttaggtactcggtagtacg

SEQ ID NO: 361302 - DNA, 746 bp, Homo sapiens
  misc_feature: GZ8MTXP02GU7LE.21.4.A04.1.454.CMB.2.raw
tcagtcgtcgctcgcacgaccggtgctcgatttagagtagtgatcaggggagctctgagagcggagcccagcccagaattcccaggtgtttcatttggtgatcagcactgaacacagaggactcaccatggagtttgggctgagctgggttttccttgttgttatttacaaggtgtccagtgtgaggtgcagctggtggagtcgtgggggagacgttggtccagcctggaggtccctgagactctcctgtgcagcctctgcacttcaccttcagtcgaccacaacagtcggactcggggtcccgccgagggcctacccggaagggggaaagggggccgttaggggacgggttcgggggtccgggtacccggttaaagtttaaccggaaaaggggtaaaacgaccgttaaaacgaacggtttaaccaaaggttaaaccgagggtaaaagtaaccgggggccgtaccggttacgttagggtaggtaaaaacgggggtaacggtttccaaacccggtataccgtacgaaaagaggtataaggtaatttaaccaaaagtaacttacacgttaggtattaccgtagactaaaaagtacgaaaactacgaccctaaacgggaaaaacccgagggggaaacctacggggtacccgtttaggttaaactttacgtttagggtaggggtaaaacgtaaaacgaaaagggtacggtggtaagtaggggttaggggtagttaacggcgttaggtacg

SEQ ID NO: 361303 - DNA, 566 bp, Homo sapiens
  misc_feature: GZ8MTXP02JMUVK.21.4.A04.1.454.CMB.2.raw
  modified_base (216)..(216): a, c, t, g, unknown or other
  modified_base (351)..(351): a, c, t, g, unknown or other
  modified_base (356)..(356): a, c, t, g, unknown or other
  modified_base (530)..(530): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtgaccacaacatggactggggtcccgccaggcctcgaggggaggggctggagtgggtcgcgtatacgaaggaanctaanagttacagtacagaactacggcgcgtctggtagaaagggtaagttcaaccgatctacaaagagatgattacaaaagactcactgtactctagacaaatcgaaacacggacctaaggaaaacccggaggaacacgggtaccgtagtattatggtacgggtaagaacgtaaaaggngtaaggagtacgggtaggtacggtacgtcgtgtacg

SEQ ID NO: 361304 - DNA, 788 bp, Homo sapiens
  misc_feature: GZ8MTXP02IHWB8.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagtacgttgggtccaggccgtgggacgggtccctggacgtacctctcctgtgcacgccctctgctacttccaccttcacgtacgacccaacaacagtcggacgtcggggtccccgccgaacgggcccgtccggaagggggaacggggtcgtagggggtacggttcgggggtaccggtaccggttaaagttaacggaaaacggggtaaaacgtactaaacgtagttaacgaacgttaacgaggtaaacgtacgggcgtaccgttacgtaggaacggaaaaggggtaacttccgaaacctatccgtaacgaaagtagaacttagtaacgttaaacgaaaagtaacctacgtacttagtacttacgaaggtaacaaaagtacgaaaaccgtaacgtaaccggtaaaacggaaaaacccgggcggtaaaacccggtaaaccggggttccgttaaaggttttaaagtttaacggtttaggggtaaaacggttaaaaccggtaaaacgtaaaaagggttgggtaaggggtatttacgggggttacggggttaggttaacgtacggtttacggtaaccg

SEQ ID NO: 361305 - DNA, 595 bp, Homo sapiens
  misc_feature: GZ8MTXP02GQ6IX.21.4.A04.1.454.CMB.2.raw
  modified_base (308)..(308): a, c, t, g, unknown or other
  modified_base (357)..(357): a, c, t, g, unknown or other
  modified_base (387)..(387): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttgggtccagcccgtgggacgggtccctgagactctcctgtgcagcctctgcattcaccttcagtgaccacaacatggactgggtcccnccaggctccgaggggagggctgggagtgggtcgccgtatacgaaggaanctaacagttacagtacagaactacgggcgngtctagtaggaaaagggtaggttacaacctatctacaaagagatgaacttacaaaagaactacactgtatctagacaaatgaaacagaccgtaacgaaaaccggaggaaccgtacgggtaccgttagttaattacgttgggtaaggttaagaaaacgtaaaaggtaggtaagggtaatgggttagggtaggtaggtcgttaggtacgg

SEQ ID NO: 361306 - DNA, 596 bp, Homo sapiens
  misc_feature: GZ8MTXP02FWATZ.21.4.A04.1.454.CMB.2.raw
  modified_base (360)..(360): a, c, t, g, unknown or other
  modified_base (486)..(486): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgtttggtccaggcccgtgggacgggtccctgagactctcctgtcgcagcctctgcattcaccttcagtgaccacaacatggactgggtccgccaggctcgagggagggctggagtggcgcgtatacgaaggaaagctaaacngtaacagtaacagaatacggcgcgtctggtaagaaaggagttcaaccgtatactacgaaagagattgaagttacaaaaagtactacaacgttagtaacttctacggtaaacaaaagtacgaaaacncggtaccctaaaaggaaaacccggagaacgaccgggtacgtagttaattagttgggtacgtaagaaacgaaaaggtagtaagaggtggtacgggtagtacgcgtgtaacg

SEQ ID NO: 361307 - DNA, 587 bp, Homo sapiens
  misc_feature: GZ8MTXP02I6FX6.21.4.A04.1.454.CMB.2.raw
  modified_base (217)..(217): a, c, t, g, unknown or other
  modified_base (353)..(353): a, c, t, g, unknown or other
  modified_base (452)..(452): a, c, t, g, unknown or other
  modified_base (469)..(469): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttccttgttgttattttacaaggtgtccagtgtgaggtgcagctgggtggagtcgtggggganacttggtccaggcctggagggtccctgagactctcctgtgcagcctctgcattcaccttcagtgaccacacatggactgggtccgccaggctcgaggggagggctggagtgggtcgcgtatacgaaggaagctaanagttacagtacagaactacggcgcgtctagaggaaaggtaaggttccaacccgtatcgtacaaagagactgaattacaaaagactcaaacttgtaactntagacaaaagtcgaaanacggccctaaagaaacccgagaccgacggacgtagttaattagttaggagggttaaacgaaactaaaagggtgttaaggggaattgggtacggggttaggaacgttcgtaagggttac

SEQ ID NO: 361308 - DNA, 595 bp, Homo sapiens
  misc_feature: GZ8MTXP02I9P31.21.4.A04.1.454.CMB.2.raw
  modified_base (216)..(216): a, c, t, g, unknown or other
  modified_base (303)..(303): a, c, t, g, unknown or other
  modified_base (345)..(345): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtgggagggtccctgagactctctgtgcagcctctgcattcaccttcagtcgaccacaacatggactgggtccncaggctcgagggaggctggagtgggcgcgtatacgaaggaanctaacagtacagtacagactacggcgtcgtctaggtagaaaaggtacgttccaaccagtactacgaaagagatagtaacttaaccgaaaagactcgaactgtaactcgtaggactaaaagtacgaaacacgaccgtaaacggaaaaaccgagggaacccacgggtaccgttagttaaacgttacgttggtaaaggtaacgaaaacgaaaggtagtaaggaattcgggtaggtacggtagtcgtagtaacg

SEQ ID NO: 361309 - DNA, 541 bp, Homo sapiens
  misc_feature: GZ8MTXP02G3KLW.21.4.A04.1.454.CMB.2.raw
  modified_base (382)..(382): a, c, t, g, unknown or other
  modified_base (517)..(517): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcagctggtggagtcgtgggggagacttggtccagcctggagggtccctgagactctcctgtgcagcctctgcattcaccttcagtgaccacaacatggactgggtcccgcaggctccgaggggagggctggagtggggtcgccgtatacaaaggaagctaaacagttacagtacagaatacggcgacgtntagtaggaaaaggaacggttcaacccgtatactacaaagagatagattacaaaagactacactagtatctgacaaaatcgaaacagactacgaaaaccgagacacggtcgtagtattatgtagtagaacaaaagngtgagtgtaggtgtacgctgtacg

SEQ ID NO: 361310 - DNA, 592 bp, Homo sapiens
  misc_feature: GZ8MTXP02IORY0.21.4.A04.1.454.CMB.2.raw
  modified_base (201)..(201): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctctcctgcagctccagccagaatatccagagcctactacatacgcctggtaccagcagaagcctggccaggcctcccaggttccctcatctatgcgtcggtcccagacgggcccacgtggccactccccgaagaccaggtttccagtcggctaggtcggggtactgggggaccaggtaccttcaccgtctacatactattacgacagtacgtggacgccgtagaacgtattacgctaggttgttacttacgttgtactaggtactagttagtaggtaaagttcaccgttcgtcgttccggttacggaccgtaagggaccgtaaaggtaagtaaacgtacggaaacgtaacgtggtacggtaccgtacgacgtacctactcttacg

SEQ ID NO: 361311 - DNA, 580 bp, Homo sapiens
  misc_feature: GZ8MTXP02GWC2J.21.4.A04.1.454.CMB.2.raw
  modified_base (374)..(374): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctgggagggtccctgagactctcctgtgcagcctctgcattcaccttcagtgaccacaacatggactggggtccgcaggcctccgagggaaggggctgggagtgggtcgaccgtatacgaaggaaagctaaacagttacagtaacngaaatacggcgcgtctagtagaaaagggaaggttcaaacctatactacgaaagagatagaattacgaaaagactacaacgtagtatctagacaaaatagaacaacgacgtaacgaaaaccgaacggaacgacggaccgtagtattagttagtaggtagtaacgaaaagaagtaaggagtaggtaggtaggtacggtacgtagtacg

SEQ ID NO: 361312 - DNA, 679 bp, Homo sapiens
  misc_feature: GZ8MTXP02FGLGQ.21.4.A04.1.454.CMB.2.raw
  modified_base (356)..(356): a, c, t, g, unknown or other
  modified_base (362)..(362): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccgccaggcctccgaggggaaggggctgggaggtgggtcggcgtatacgaaggaanctaaanagttaacagtaacagaactacgggcgcgtctggtaggaaaagggtaacggttcaacccgatactacgaaagagatagaattacgaaaaagtaacctactaacgtaggttactacgttacgaaacctaaaagtacggaaaaccgacgaacccgtaaacgggaaaaaacccgggacgggaaaaccgaacccgggtacccggtttaggttaaacgtttttaacggttttaacggggtaaagtaaaaccgtaaaaaacgggtaggttaaggggtaagttacgggttaggggttagggtaggtcgtaggttacggtaaaccg

SEQ ID NO: 361313 - DNA, 857 bp, Homo sapiens
  misc_feature: GZ8MTXP02IIHBG.21.4.A04.1.454.CMB.2.raw
  modified_base (262)..(262): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtgggggagacttggtccagccgtggaggtccctgagactctcctgtgcagcctntgctattccaccttcagtcgaacccacaacagtcggacgtcggggtcccgccgaggcctaccggaaggggaacggggcgtggggaggtcggggtaccggaccgttaaagttaaccgaaagggaaaacgtcctaaaacgtagtttaacgaaaggttaaccaggtaaacgtaccggggccggtaccgttacgtagggtaacgggaaaaacgggtacggtttccaaacccgtaagtccccgtaacgaaaaggtaggtaaacttaggtaaaactttaaaccgaaaaaacggtaacccttaccgtaaaccgtttaggttaaacttcccgttaagaaacccgttaaaaaagtccgaaaaaccgtaccgggtaaacccgttaaaaacggggaaaaaacccccggtaggggaaaaccccgtaacccgggggtttaacccgtttaaaggttttaaacgttttaaacgggtttacggggttaaacgggggttaaaacgaaaaaaaccggtaaaaaagggttcggggttaagggggtaaagtttacggggggtttacgggggttaacccggggttaacggttacccgggtttaagggttaaaccgg

SEQ ID NO: 361314 - DNA, 735 bp, Homo sapiens
  misc_feature: GZ8MTXP02HNX45.21.4.A04.1.454.CMB.2.raw
  modified_base (585)..(585): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctggacgggtccctgagactctcctgtgcagcctctgcattcaccttcagtcgaccacaacagtggacgtcgggtcccgccgaggcctccggaggggaaggggcgtggggaggtcggggtccggtaccgtaagttaacgaaagggaaaacgactaaacaagttaacaagtaacagaaacgtacggcgcgtctaggtaagaaaagggaacgttccaaaccctataccgtacgaaaggagtaataggtaaacttaaaccgaaaaagtaaccttaccaaacgtttaggttaactttcgtaacgaaacctaaaaagttcgaaaaacctacggaaccccgtaaaagggaaaaaaccccggngggaaaacccgaaacccggggttaccgttaaggtttaaacgtttaaacgttgggtaaaggttaaaacgaaaaaccgtaaaaaagggagggttaagggaaagttacggggttacggggttaacggttaaggtccggtttaggtaaacccgg

SEQ ID NO: 361315 - DNA, 583 bp, Homo sapiens
  misc_feature: GZ8MTXP02IPOMX.21.4.A04.1.454.CMB.2.raw
  modified_base (281)..(281): a, c, t, g, unknown or other
  modified_base (365)..(365): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtcccagcctgggagggtccctgagactctcctgtgcagcctctgcattcaccttcagtnacccacaacatggactgggtccgccaggcctccgaggggaaggggctgggaggtgggtcggccgtagttacgaaggaagctaanagttacagtacagaatacggcgcgtctagtagaaaggtaagtcaccgtatctacaaagagattagaattacaaaagactacacttgtaacttctagaccaaaagtcgaaacgagacctaaggaaaaccgtaggaaccgacgggtccgtagttattaagttggtaggtaagaacgaaaagtaggtaaggtacgtaggtcgggtaggtacgcgtagtacg

SEQ ID NO: 361316 - DNA, 799 bp, Homo sapiens
  misc_feature: GZ8MTXP02G4L06.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagcgttgggttttccttgttgttattttacaaggtgtccagtgtgaggtgcagcgtggtggagtcgtgggggatacgttggtccagccgtgggacgggtccctgacgtacctctccgtgtgcagcctctgctattccaccttcgagtcgaaccctaacaacagtcggacgtcggggtcccgccgaggccgtaccggaagggggaacggggtcgtaggggagggttcggggtaccggtaccgttaaaggttaacgaaaacggggtaaaacgtaccgtaaaacgtaacggtttaacgaaacggttaaccgaaggtaaacggtaccgggccgtaccgttacgttaagggtaaacgggaaaacgggtacgtttacccaaacccgttagtacccgtaagaaaagggtagtaattagtaaaactttaaacgaaaacgtaccttacgaacgtttagtacgtcgtaagaacctaaaagaccgaaaacgaccgtaccgaaaacggaaaacccggaggtaaacccgacgggggttactttaacggttttaatttaaacgggttacgggttaaaagggtaaaccgtaaaaacggtaaaagggttaggtaaccggggtagtttagggggtacccgggtaggtttaacggcccggtttaggaacccgg

SEQ ID NO: 361317 - DNA, 655 bp, Homo sapiens
  misc_feature: GZ8MTXP02JI7IK.21.4.A04.1.454.CMB.2.raw
  modified_base (267)..(267): a, c, t, g, unknown or other
  modified_base (281)..(281): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagtttgggctgagctgggttttccttgttgttattttacaaggtgtccagtgtgaggtgcagctgggtggagtcgtgggggagacttggtccagcccgtgggacgggtccctgagactctcctgtgcagcctntgcattccaccttnagtcgacccacaacagtcggactcgggtcccgccgaggcctccggaaggggaacggggctagggaggtggggtcggaccgtataacgaaaggaacgctaaacagttacagtaacagagtacggcgcgtcgtaggtaggaaaaggtacggttaccaacctaacttcgtacaaaggagtatagaaactttaacaaaagacctactaaacgttgttactactagaactaaaagttagaaacctaggaccctaaaggaaaaacccgaggtaaccgaccgggtaccgttagttaacgtttagttagggtacggtaaagaacgtaaaaaggtggttagggaagtggggttagggtaggtacgtcgttaggtacgtaaccg

SEQ ID NO: 361318 - DNA, 607 bp, Homo sapiens
  misc_feature: GZ8MTXP02GJRO7.21.4.A04.1.454.CMB.2.raw
  modified_base (203)..(203): a, c, t, g, unknown or other
  modified_base (269)..(269): a, c, t, g, unknown or other
  modified_base (291)..(291): a, c, t, g, unknown or other
  modified_base (297)..(297): a, c, t, g, unknown or other
  modified_base (406)..(406): a, c, t, g, unknown or other
  modified_base (416)..(416): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatagcctggtaccagcagancctggccaggctccaggttccnatctangctcgggtcccagacgggcccacgtggacactcccgagacaggttcaggtggcgtaggtggggtctgggggactaggtaccttcactctcatcattagcagactggacncctagaagtnttacgcgtagttgttaattactggtcaggctaagtagtaggtaacgttctaccgttgttcggttaccggttacgggacccgtaaacgggggtaacccgtaaaaggggttaaacgaaaacgtacgggtaaaaacccgtacgttaagggtacgggtacttacgggacctaacccgttagttaaccgtttaccg

SEQ ID NO: 361319 - DNA, 652 bp, Homo sapiens
  misc_feature: GZ8MTXP02HUXJK.21.4.A04.1.454.CMB.2.raw
  modified_base (199)..(199): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaancgccacctctcctgcagcctccagccaagaatatccagacgctaactacatacgcctaggtaccagcagacgccgtggaccaggcctacccgaggttcctcattctatcgcgtacggtcccacgacggccctacgtcggacacgtccccaggaccgtaggttcgagtggcgtaggttcggtactggggacacggtcttccgactctactatctaattacgacgtaagacgttacggacgtaccgtagtaaacggttctttacgacgtaggtttcgttaatttacgttgtacgtagtacgtagttagtacgggttaagttccaccgttcgttacgttaccggttacgggaacccggttaaacgggaaaccgtaaaaggggttaacaaaaggtaaacggtaaaacgtacgttaaggtacgggtacttacggacctaactacgtttaccgtttacg

SEQ ID NO: 361320 - DNA, 583 bp, Homo sapiens
  misc_feature: GZ8MTXP02GOCJ2.21.4.A04.1.454.CMB.2.raw
  modified_base (266)..(266): a, c, t, g, unknown or other
  modified_base (279)..(279): a, c, t, g, unknown or other
  modified_base (305)..(305): a, c, t, g, unknown or other
  modified_base (387)..(387): a, c, t, g, unknown or other
  modified_base (391)..(391): a, c, t, g, unknown or other
  modified_base (415)..(415): a, c, t, g, unknown or other
  modified_base (419)..(419): a, c, t, g, unknown or other
  modified_base (436)..(436): a, c, t, g, unknown or other
  modified_base (486)..(486): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggtccctgagactctcctgtgcagcctntgcattcaccttnagtgaccacaacatggactgggtccncaggcctccgaggggagggctgggaggtcgggtcggccgtagttacgaaggaaagctaaagagttacagtacagaatacggncgtntagtagaaaggacgtcaccatcanaagngatgaatacaaagactnactgtatcgagacaaaagtcgaaacacgtcccgtaaagaaaaacccgggnggaaccgtacggtacgttagttaacgtttacgtaggtaacggtaaacgaaacgtaaaaggtggtaaggtagttgggtaggtacggtatcgtagtacg

SEQ ID NO: 361321 - DNA, 568 bp, Homo sapiens
  misc_feature: GZ8MTXP02HT3F6.21.4.A04.1.454.CMB.2.raw
  modified_base (305)..(305): a, c, t, g, unknown or other
  modified_base (356)..(356): a, c, t, g, unknown or other
  modified_base (363)..(363): a, c, t, g, unknown or other
  modified_base (450)..(450): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaggtgtccagtgtgaggtgcagctggtggagtcgtgggggagacttggtccagcctgggacggggtccctggagactctcctgtgcagcctctgcattcaccttcagtgaccacaacatggactcgggtccnccaggctccgaggggagggctgggagtgggtcggccgtatacgaaggaaanctaaacngttacagtacagaatacggcgcgtctggagaaagggacgttcaacgatctacaagacgatagattacaaagtactacactgatctanacaaatgaaacagacctaaagaaaccggagaccgacggtaccgtagttacttataggtagtaacgaaactaaaaggagtaaggtaatacggtaggggtagtacggtcgtttaggacgg

SEQ ID NO: 361322 - DNA, 577 bp, Homo sapiens
  misc_feature: GZ8MTXP02F1C0Z.21.4.A04.1.454.CMB.2.raw
  modified_base (279)..(279): a, c, t, g, unknown or other
  modified_base (324)..(324): a, c, t, g, unknown or other
  modified_base (383)..(383): a, c, t, g, unknown or other
tcagtcgtcgctcgcacgaccggtgctcgatttagagtagtgatcagggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtnaccacaacatggactgggtccgccaggcctccgagggaaggggcngggagtggggtcgcgtatacgaaggaacgctaacagttacagacagagtacgcgcgtcngtagaaagggtagttacaccatctacaagagatagaattacaaaagaactcacgttagtatctagacaaaatagaaaccgagaccgtaagaaaacccggaggaaccgacggccgtagttacttagttggtaaggtagtaaacgaaaagtggtaggaagttaggtggttacgggagtacgtacggtaggtaaccg

SEQ ID NO: 361323 - DNA, 569 bp, Homo sapiens
  misc_feature: GZ8MTXP02JC0N9.21.4.A04.1.454.CMB.2.raw
  modified_base (200)..(200): a, c, t, g, unknown or other
  modified_base (237)..(237): a, c, t, g, unknown or other
  modified_base (288)..(288): a, c, t, g, unknown or other
  modified_base (394)..(394): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccgggctcagaaaccaccggagaaattgtgttgacgcagtctccaggcaccctgtctttgtctccaggggaaangccacctctcctgcagctccagccagaatatccaganctactacatagcctggtaccagcagaagcctggccaggctcccaggttccnatcatgctgggtcccacgagggccacgtggcacgtcccagacctaggttcccagtcggcaggtgggctggggacaggacttcactctcatcattagcagactggancctagaagtatttcgctagttagtacttacgtgttacagtactagtagtggtaaagttccaacgttctgtacgttacgaaccgtaacgggaacctaaaggtaaacgaaaagttacggaaaaacgtaccgttaggtaaggacgttacggtaccaaccgtacttcgtacgtttaccc

SEQ ID NO: 361324 - DNA, 578 bp, Homo sapiens
  misc_feature: GZ8MTXP02IW15A.21.4.A04.1.454.CMB.2.raw
  modified_base (306)..(306): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgacccacaacagtggactcggggtccnccgaggcctccgaggggagggctgggagtgggtcggcgtatacaaggaagctaacagttacagtacagaatacggcgcgtcgtagtaggaaagggaagttcaaccatctacgaaagagatagaattacgaaaagtactacaacttgtaactcgtagtacaaaagtgaaacagacctaaggaaaccgaggaccacgggtcctagtattacgttggtaggtaacgaaaacgaaaaggtggtaaggagttcgggtaggtggtaagcgtggtaacg

SEQ ID NO: 361325 - DNA, 551 bp, Homo sapiens
  misc_feature: GZ8MTXP02J2ANF.21.4.A04.1.454.CMB.2.raw
  modified_base (301)..(301): a, c, t, g, unknown or other
  modified_base (354)..(354): a, c, t, g, unknown or other
  modified_base (485)..(485): a, c, t, g, unknown or other
  modified_base (511)..(511): a, c, t, g, unknown or other
  modified_base (522)..(522): a, c, t, g, unknown or other
  modified_base (544)..(544): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccnccaggctccgaggggaaggggctgggagtgggtcggccgtatacgaaggaaanctaaacagttacagtacagaaatacggcgacgtctaggtagaaaagggaagttcaacccatcctagaaagagatggaattacaaaagaactcaactgtatctgactaaatgaacagacctaagaaaaccgngacacggccgtagtatattgaggtanaactaaaaggngtggagtggtaggtaggtacgngtagtcg

SEQ ID NO: 361326 - DNA, 719 bp, Homo sapiens
  misc_feature: GZ8MTXP02FY72A.21.4.A04.1.454.CMB.2.raw
  modified_base (328)..(328): a, c, t, g, unknown or other
  modified_base (676)..(676): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtggaggtgcagctgggtggaggtcgtgggggagtacgttggtccaggccgtgggacgggtccctggagactcctcctgtcgcacgcctctgctattccaccttcagtcgaacccacaaacagtggaccgtggggtccccnccgaggccctaccggaagggggaacggggctggggacggttcggggtccggaccgttaaagtaacgaaaggggaaacgtacctaaagacgtttaacaagtaacagggaaactacgggcgtcgtctaggtagggaaaaggtacgttccaaccgatccgaagaaagagatagtaacttaacaaaaacgcttaacacgttagtaactcgtagaaaacctaaaagtccgaaaacacggtacccgtaaaaagggaaaacccggacggaaaccggtacccggtccggtttaaagtttaagtttacggttaggtaaacgggttaagaaaaaccgtaaaggggtagttaacggggngtttaggggtacggggttaggtaaccgtggtacggttaaccgg

SEQ ID NO: 361327 - DNA, 624 bp, Homo sapiens
  misc_feature: GZ8MTXP02IUEZD.21.4.A04.1.454.CMB.2.raw
  modified_base (216)..(216): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtggggganacgttggtccagccgtggacgggtccctgagctctctgtgcagcctctgcattcaccttcagtcgaacccacaacatggacgtggggtccgcaggcctccggaaggggagggctgggaggtcggggtcggccgtaagttacgaaacggaaagcgtaaaacgagttaacagtaacaggtaacgtaccgggcgtacgtcgtaggtaggaaaaggtaacgttccaaccgtatcgtacgaaagagatagaattacgaaaagactacacgttagtacttcgtagactaaaagtcgaaacacgtacccgtaaacggaaaacccgaggaccaacgggtcgttagttaagttagtttggtaaggtaacgtaaaacgaaaaggtaggtggtagtggtacgggtgtaagtctagtacg

SEQ ID NO: 361328 - DNA, 615 bp, Homo sapiens
  misc_feature: GZ8MTXP02IP1CG.21.4.A04.1.454.CMB.2.raw
  modified_base (360)..(360): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactggggtccgcgaggcctccgaggggagggctgggagtgggtcgccgtatacgaaggaaagctaaanagttacagtacaggaatacgggcgcgtcgtgtagaaagggagttcaccgatctacaaagagatagaattacaaaagtactcaaacttgtaactctagactaaaagtcggaaacacgacctaaaaggaaaacccggagggaccgtacggggtacccgttaggttaaatttacggttagggtaaggtaaacgaaaacgaaaaggtaggttaaggggaaacttggggttaggggtacggttaggcgttaggtaaccgg

SEQ ID NO: 361329 - DNA, 732 bp, Homo sapiens
  misc_feature: GZ8MTXP02I7VQV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggcctgggagggtccctgagactctcctgtgcagcctctgcattcaccttcagtcgaccacaacagtggactgggtcccgccgacggcctaccggaggggaacggggcgtaggggacggtcggggtaccggaccgttaaagttaaccggaaaaggggaaaacgtaccgtaaaacgtaacgtttaaccgaaaggttaacaggtaaacgtaccggggccgtaccgttacgttagggtaaacggaaaaggggtaacgttaccaaaccgtagtactacgaaaagtagattagtaacttaacgaaaagtacctacacgttagtacttacgtagaaccgaaaagtacgaaaacgacgtaccgtaaaacgaaaaacccggtcgggaaaccgtaccgggtacgtttagttaaagtttaacggttaggttaaacgggtaaaagaaaacggtaaaaaggtaggttaagggaagtttcggggtaggttaggggtaacgtccggttaaggtaaccgg

SEQ ID NO: 361330 - DNA, 509 bp, Homo sapiens
  misc_feature: GZ8MTXP02IHZTN.21.4.A04.1.454.CMB.2.raw
  modified_base (201)..(201): a, c, t, g, unknown or other
  modified_base (239)..(239): a, c, t, g, unknown or other
  modified_base (266)..(266): a, c, t, g, unknown or other
  modified_base (289)..(289): a, c, t, g, unknown or other
  modified_base (365)..(365): a, c, t, g, unknown or other
  modified_base (469)..(469): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaaangccaccctctcctgcagctccagccagaatatccaganctactacatagcctggaccagcagaancctgccaggcctcccaggttccnatctatgctggtcccagagggcccacgtggcatccccagacaggtcagtgcaggtggtctggggacagcttcactntacatcatagcagactggagccgtagaagtatttcgacagttgtatttactgtcagcagtagtgtaagttcacctctgtcgttcgacgaaaggaccaaaggtanaaactagaaaacgacgtaagtgactagacacacgtctacg

SEQ ID NO: 361331 - DNA, 599 bp, Homo sapiens
  misc_feature: GZ8MTXP02I31S5.21.4.A04.1.454.CMB.2.raw
  modified_base (261)..(261): a, c, t, g, unknown or other
  modified_base (324)..(324): a, c, t, g, unknown or other
  modified_base (498)..(498): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctntgcattcaccttcagtgaccacaacatggactgggtccgcaggctccgaggggagggctgggngtgggcgcgtatacgaaggaagctaacagtacagtacagagtacggcgcgttctgtaggaaaagggtacggttccaacctatccgtacaaagagacgtgtaacttacaaaagacctacaacgttagtaatcgtagacctaaaagtacgaaacacgacctaaggaaaaacccggnggaaccgaccgggtccgttagtactttagttcggtaggtaaacgaacgtaaaaaggtggtaggaagttggtagggttaggtacgtacgttggtacgtaacg

SEQ ID NO: 361332 - DNA, 710 bp, Homo sapiens
  misc_feature: GZ8MTXP02IZ536.21.4.A04.1.454.CMB.2.raw
  modified_base (640)..(640): a, c, t, g, unknown or other
  modified_base (658)..(658): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgtttattttacaaggtgtccagtgtgaggtgcagcgtggtggagtcgtgggggagtacgttggtccagccgtggacgggtccctgagactctcctgtcgcagcctctgctattcctaccttcgagtcgaacccaacaacagtggacgtcggggtccccgccgaaggcctaccggaaggggaacggggtcgtgggaggtcggggtccggacgtaagttaacgaaaggaaacgactaaacgagttacaagttaacagtaacgtacggcgtacgtacgtagggtaaacgaaaagggtacgttcccaaccgtatacgtaacgaaagagtataagtaacttaacgaaaaactactcccgtaaattaggttaactcctaaacgtaacaaaaagttccgaaaaccgtaggaccccgtaaaacgggaaaaccgaggaccgaaccgggtacgttagtttaaagttcgttaacgggtaagggtaaanaaaaacggttaaaagggnggttaagggtagttaggggttacggtaaagggtcaccggtttaggaaacccg

SEQ ID NO: 361333 - DNA, 666 bp, Homo sapiens
  misc_feature: GZ8MTXP02GXEP2.21.4.A04.1.454.CMB.2.raw
  modified_base (262)..(262): a, c, t, g, unknown or other
  modified_base (353)..(353): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctntgcattcaccttcagtgaccacaacatggactgggtccgccaggcctcgaggggagggctgggagtgggtcgccgtagttacgaaggaaanctaaacagttacagtacagtaactacggcgtcgtcgtagtaaggaaagggtacgttcaaacccgtatcctaacgaaagatagtagtaaacttacgaaaagtaacctacgtaacttgtaacttcgtagactaaaagtcgaaactacggaccctaaaggaaaaccccggagaaacccgaccggggtacctttaggttaaacttttagggtttacgggtaagggttaaacgaaaaccgtaaaaaggtaggggttaagggtaaagtttgggggttaaggggtttccggggtaaaacgtcggtttagggtaaacccgg

SEQ ID NO: 361334 - DNA, 645 bp, Homo sapiens
  misc_feature: GZ8MTXP02JK5U9.21.4.A04.1.454.CMB.2.raw
  modified_base (448)..(448): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagccgtgggagggtccctgagactctcctgtgcagcctctgctattccaccttcagtcgaccacaacatggactcggggtcccgccgaggcctccggaaggggaacggggcgtgggaggtggggtccggccggtaatacgaaggaaagctaacagttacagtacaggaatacgggcgcgtacgtaggtagaaaagggtaggttccaaccgatcacaaagganaatagaacttaacaaaagtacctcactgtactcgtagactaaaatgaaaacgcgtaaccccgtaaggaaaaacccggggtagaaaccgtaccggggtaccgttaaggtttaacgtttaagttcgggttaagggtaacgaaaacgtaaaaaggtgtgggtaaacgttggtacggggtggttaacgcgttaggtaaccg

SEQ ID NO: 361335 - DNA, 652 bp, Homo sapiens
  misc_feature: GZ8MTXP02GRHSE.21.4.A04.1.454.CMB.2.raw
  modified_base (306)..(306): a, c, t, g, unknown or other
  modified_base (357)..(357): a, c, t, g, unknown or other
  modified_base (544)..(544): a, c, t, g, unknown or other
  modified_base (610)..(610): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattccaccttcagtcaccacaacatggacctggggtcccncgagctccgaggggagggctgggagtgggtcgaccgtattacgaaggaaanctaacgagttacaagttacagaactacgggcgtcgtcgttaggagaaaaggggtacgttaccaaccgtataccgtagaaaaggtagaacgtaggaaactttaacgaaaaacgtaccttaaccgacttaggtaattccgtaagaacctaaaatcgaaaaccgacgtaccctaaaacgggaaaaccggnggaaaccgaccgggtaccgttagtttaaatttcggttaggtaagggtaaacgaaaacgtaaaaggngttaaggaacgttggttagggtacggtagtcgtttaggaccg

SEQ ID NO: 361336 - DNA, 630 bp, Homo sapiens
  misc_feature: GZ8MTXP02JUD54.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctgagactctcctgtgcagcctctgcattcaccttcagtcgaccacaacatggactgggtccgccaggctccgaggggagggctggagtgggtcgcgtatacgaaggaaagctaaacagttacagtacagaagtacggcgcgtctggtagaaaacgggtaagtttccaacccagtcctacgaaagacgatggaattccaaaaagtaactcgaacttggtacttacgtagacctaaaagtcgaaaccagacccgtaaggaaaaaccccggaggaacccaccggggtaccgttagttaacttaaagtttcgggaggttaaaacgaaaccgtaaaaagggtgtcggggtaaatttacggggtggtttaccggggaatccggttaggtaaccg

SEQ ID NO: 361337 - DNA, 707 bp, Homo sapiens
  misc_feature: GZ8MTXP02GXUFU.21.4.A04.1.454.CMB.2.raw
  modified_base (328)..(328): a, c, t, g, unknown or other
  modified_base (695)..(695): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggaggtcgtgggggagtacgttgggtccaggtcccgtgggacggggtcccctggagaccttctcctgtgcagccctctgctattccaccttcagtcgaaccaacaacagtggactcggggtcccnccgaggcctaccggaaggggacggggctggggaggttcggggtaccggaccgtaagttaacgaaagggaaacgacctaaaacgagttaaccgaagttaacgaggtaaacgttaccggggcgtacgttaccgtagggtaaagggtaaaacgggggtacgtttcccaaacccgtaattccgtaacgaaaagtagtacgtagtaaacttaacgaaaaagtaccttacaactttagtaattccgtagaactaaaatacggaaaccacggtaccaaaacggaaaacccggagaccgacggggtcttagttaattacgtaggtaaaggtaacaaaacgtaaaaggtggaagtagttagggtacgggtggtaancgttacggtaag

SEQ ID NO: 361338 - DNA, 614 bp, Homo sapiens
  misc_feature: GZ8MTXP02G7ICY.21.4.A04.1.454.CMB.2.raw
  modified_base (446)..(446): a, c, t, g, unknown or other
  modified_base (580)..(580): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtgggggagacgttggtccagcctgggagggtccctgagactctcctgtgcagcctctgctattccaccttcagtgacccacaacagtggacctggggtcccgccagggcctaccgaggggaaggggctgggaggtggggtccgtccgtaattacgaaaggaaagctaaacgaggttaacaggtacaggaaactacgggcgacgtctagtagaaaagggagttcaaacccgatctanaaagagatagaattacgaaaagtacttcaacgttagtatacgtagactaaaagtgaaacctaggccctaaaggaaaacccgaggacaccgggtactaggttaattaggttggacgggtaagaaacgtaaaaggngtggaattggggtacggtagggtatcgtagtacg

SEQ ID NO: 361339 - DNA, 717 bp, Homo sapiens
  misc_feature: GZ8MTXP02GTGPB.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccaggccgtgggacgggtccctgagactctcctgtgcagcctctgcctattccaccttcagtcggaccaacgaacagtggacgtcggggtcccgccgacggcctccggaaggggaacggggtcgtaggggagttcgggggtaccggtaccgtaaagttaacgaaaggggaaacgtacctaaaacgtagttaacgaagtaacagggtaaactaccgggcgtacgtcgtaggtaacggaaaagggtaacgtttccaacccgaataccgtagaaaggtagagttagaacttaaacaaaagtaaccttacgacttagtacttcgtagaactaaaagtacgaaaaccgtacggaacccgttaaaagggaaaacccggacgggtaaccgaacccgggggttaccgttagtttaaagtttacgttaggaagggttaaagaaaacgtaaaaggtggtaagggtagtacggttacggggtggttaagcgtttagggtaacg

SEQ ID NO: 361340 - DNA, 679 bp, Homo sapiens
  misc_feature: GZ8MTXP02I466W.21.4.A04.1.454.CMB.2.raw
  modified_base (278)..(278): a, c, t, g, unknown or other
  modified_base (538)..(538): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttatttacaggtgtccagtgtgaggtgcagctggtggagtcgtgggggagacgttggtccagccgtgggacgggtccctgagacctctcctgtgcagcctctgctattcaccttnagtcgacccacaacagtggacgtcgggtcccgccgacggccgtaccgagggggaaggggcgtgggagggttcggggtaccggtccgtaaagttaacgaaaaggggaaacgtacgtaaacaggtttaacaggttaacaggtaactaccgggcgtacgttcgtaggtaggaaagggtaacgttccaaccgtatacctagaaagagtactagaattaacaaaacgtactacacgttagtacttctagactaaaagtcgaaacncggacctaaacggaaaaccgagggaaccgaccggttacgtagtttaagttacgttaggggttaacggtaaacgaaaacgtaaaaggggtaggtaagggtaagttggggtacggggttgggttaacgcgttaggtaaaccgg

SEQ ID NO: 361341 - DNA, 885 bp, Homo sapiens
  misc_feature: GZ8MTXP02H9NTZ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggcctgggacgggtccctgacgactctcctgtgcagcctctgctacttccaccttcgagtacgaccaacaacagtggaccgtcggggtcccaccgagggcctaccggaagggggaaacggggtcgtaggggacgggtcggggtcccgggtacccgttaaagttaaccgaaaaggggaaaacgtaccttaaaacgtaacggtttaacaacgggttaaaccaaggtaaaaccggtaaccggggaccggtaccggttacgtaggggtaaagaaaacgggtaaacgggttacccaaacccgtattccgtaaacgaaagtagtaataggtaaacttaaaccgaaaagtaaaccttcgtaaccgttagtaactttacctaggtaaaccctaaaaagtacggaaaaacccgtacggtaaaccccgtaaaacggggaaaaaaaaccccgggtacggggaaaaccccggtaaccccggggttaaccgttaaacgggtttttaaaggttttaaaccggttttaaagggggttaaaaccgggttaaaaaggaaaaaacccggttaaaaaggggtaaacgggggtttaagggggtaaaggtttacgggggtttaacgggggttaaaggggtttaccggttaacccgggttttaaagggtaaaccccggg

SEQ ID NO: 361342 - DNA, 653 bp, Homo sapiens
  misc_feature: GZ8MTXP02GAXXF.21.4.A04.1.454.CMB.2.raw
  modified_base (446)..(446): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgacgactctcctgtgcagcctctgctattccaccttcagtcgaccacaacatggactcgggtcccgccgaggcctaccggaggggaacggggctggggaggtcggggtcgaccgttaagtaacgaaggaagctaaacgtagttaacagtaacaggtaactacgggccgcgtctaggagtaaaaggacgttacactatacanaagagatagaacttacgaaaagtactacgaacttagtactcgtacgaactaaagacgaaacaacggtacccgtaaaaggaaaaccccgagggtaacccgacccgggtacgttagttaatttaacggttagggtaacggttaaaacgaaacgtaaaagggtaggtggaagtttggtaacggggttgtaaaccggtcgttaggtaaccg

SEQ ID NO: 361343 - DNA, 636 bp, Homo sapiens
  misc_feature: GZ8MTXP02FSTXP.21.4.A04.1.454.CMB.2.raw
  modified_base (349)..(349): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggttgagctgggttttccttgttgttattttacaaggtgtccagtgtgaggtgcagctggtggagtcgtgggggagacttggtccagcctggagggtccctgagactctcctgtgcagcctctgcattcacttcagtgaccacaacatggactgggtccgcaggctccgaggggagggctgggagtgggtcgccgtatacgaaggaacnctaacagttacagtacagatacgggcgcgtcgtagtaaggaaaggtagttcaaccgatctacgaagagatagattacgaaagtaactacaacgttgtaactcgtagaacctaaaagttacgaaacctaacggtacccgtaaacggaaaaaccggacgggtaaccgacggggtacccgttaggtttaaacgtttagtttacgggttaagggttaagaaaccgtaaaaaggaggttaggaaggtttggtacggggttagggttaacgtacggttaggtacgtaaaccgg

SEQ ID NO: 361344 - DNA, 871 bp, Homo sapiens
  misc_feature: GZ8MTXP02IJP59.21.4.A04.1.454.CMB.2.raw
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctcgcacttcaccttcacgtcgacccaacaacagtggacgtcgggtcccgccgaggcctaccggaagggggaacggggtcgtggggacggttcgggggtaccggacccggttaaagttaaaccggaaaaggggtaaaacccgtaccgttaaaacggtaacgttaaaaccgtaacggttaaaccgaaagggtaacgttaaacccgggggcccggtaaccgtttaccggtaagggttaaaggggaaaaacgggttaaacggggtttaccccaaacccgtaaacgttacccgttaaaccgaaaaggtaaacgtaacgttaagtaaacgtttaaacccaaaaaaagggtaaacccttaccgtaaacccgtttaggtaaactttaccgttaacggaaacctaaaaagttaacggaaaccaaacggtaacccgtaaaacgggaaaaaacccgggacgggaaacccgtaacccggggaaccggtttaacggtttaaaacgtttaaggtttaacgggttaaaggggttaaaaccgaaaacggtaaaaagggtaacggttagggtaagttagggttacggggttacggtaaaggtccgttaaggtttaccgaaaaccgg

SEQ ID NO: 361345 - DNA, 611 bp, Homo sapiens
  misc_feature: GZ8MTXP02I6PCH.21.4.A04.1.454.CMB.2.raw
  modified_base (201)..(201): a, c, t, g, unknown or other
  modified_base (290)..(290): a, c, t, g, unknown or other
  modified_base (311)..(311): a, c, t, g, unknown or other
tcagtcgtcgctcgcacgaccggtgctcgatttagagtagtgatcagggggaagagctgctcagttaggacccagagggaaccacggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagagcctggccaggctcccgaggttccnatctatcgctcgggtcccagngggccacgtggccactcccagacaggttccaggtggcaggtgggtcctgggactagaccttcgaccttcgtacattacctagttacgcacgacgtgggactccgtagaagtacgtttcgactagttgttaagtttacctaggttacagtcgtaagttagtaggtaactttccgaacttcgttacgtcggtttaccgggaaccgtaaagggtaaacccaaaggggtaaacaaaagttacggaaaaccgtaagttacggtaaggtaccgtacggacctaccgtacgttccgtacgttttacc

SEQ ID NO: 361346 - DNA, 549 bp, Homo sapiens
  misc_feature: GZ8MTXP02IR4TE.21.4.A04.1.454.CMB.2.raw
  modified_base (202)..(202): a, c, t, g, unknown or other
  modified_base (291)..(291): a, c, t, g, unknown or other
  modified_base (308)..(308): a, c, t, g, unknown or other
  modified_base (424)..(424): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccagagctactacatagcctggtaccagcagaagctggccaggcctccagttccncatctatgctggtccangggccatggcactccccgaagactacgggttccagtggacgaggttcggggttctgggggacacggtacctttccaacttctcatcattagcagtactggagcctagagtattcgntagtgtattactgtcagacagtatggtaacgttcacgtctgtcgttcggactaaagggactaaagggataaacgtaacggaaacgtaagtaaggtacggactacggacctaccgtagttcttacg

SEQ ID NO: 361347 - DNA, 566 bp, Homo sapiens
  misc_feature: GZ8MTXP02IV2DQ.21.4.A04.1.454.CMB.2.raw
  modified_base (277)..(277): a, c, t, g, unknown or other
  modified_base (282)..(282): a, c, t, g, unknown or other
  modified_base (348)..(348): a, c, t, g, unknown or other
  modified_base (374)..(374): a, c, t, g, unknown or other
  modified_base (473)..(473): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcacttcagtnaccanaacatggactgggtccgccaggcctccgaggggagggctggagtgggtcgcgtatacgaaggaacnctaacagttacagtacagatacggcncgtctgtagaaagggagttcacatctacaagagatcgaattcaaaagactcactgtaatcctagaccaaagtagaaacacgacgtaacggaaaaaccgnggaacgaccggaccgttagttatttagttcggtaggtaaacgaacgaaaaagtggtagaagtggttaggtacgggtatcgtaggtagtaaccg

SEQ ID NO: 361348 - DNA, 628 bp, Homo sapiens
  misc_feature: GZ8MTXP02FEHG3.21.4.A04.1.454.CMB.2.raw
  modified_base (279)..(279): a, c, t, g, unknown or other
  modified_base (387)..(387): a, c, t, g, unknown or other
  modified_base (436)..(436): a, c, t, g, unknown or other
  modified_base (441)..(441): a, c, t, g, unknown or other
  modified_base (448)..(448): a, c, t, g, unknown or other
  modified_base (479)..(479): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggttttccttgttgttattttacaaggtgtccagtgtgaggtgcagctggtggagtcgtgggggatacgttggtccaggcccgtggggacggggtcccctagacgaccttctcctggtcgcagccctntgctattcaccttcagtcgaccacaaacatcggactggggtcccgccgaggcctaccgaggggaacggggctgggaggtcgggtcggcgtattacaaggaagctaaangttacagtacagaactacggcgcgtctagtagaaaagggagttcaaccntctanaaagtanatgaattcaaaagtactcactgtactcgtanaaccaaatcgaaacacggtaacccaacggaaaaacccgagggaccaacgggtccgttagttacgttaagtacgggttaggtaaacgaaaacgaaaaggtaggtaaggtaaagttccgggtaggttacgggtaagaccgttggtaaaccg

SEQ ID NO: 361349 - DNA, 729 bp, Homo sapiens
  misc_feature: GZ8MTXP02IGSP0.21.4.A04.1.454.CMB.2.raw
  modified_base (263)..(263): a, c, t, g, unknown or other
  modified_base (721)..(721): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttggctgagcgtggttttcctgttgttatttacaaggtgtccagtgtgagtgcagcgtggtggagtcgtgggggagtacgttggtccagccgtgggacggtccctgacgactctcctgtgcagcctntgctacttccaccttcgagtacaaccacaacgagtgggtacgtcggggtacccgccgacggtccgtaccggaagggggaacgggtccggtaggggtacggggtcggggtacccgggtaccgtttaaagttaaaccggaaagggtaaaacgtaccttaaaacgtaggttaaaccaaggtaacctagggaaacgttacccgggacgttaccggttacgtagggtaaagggaaaacgggtaaccggttacaaccgttaacgtacctaacgaaagtagtaagtattaacgtaaacgaaaagtacctactaaacgttaacggttaacttgtacgaaacttaaaagcgaaaacctagaccgaaaaccggaaaaccgacggaaccgaccggtacttagttagtttacgttaagggaaactaacgaaaacgtaaggtagtaaggtaacgtgggtaggtacgtacgntaggtacg

SEQ ID NO: 361350 - DNA, 658 bp, Homo sapiens
  misc_feature: GZ8MTXP02G5WGV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgctattccaccttcagtcgaacccacaacagtggactcggggtcccgccgaggcctccgaggggaaggggctgggaggtcggggtcgcgtatacgaaaggaagctaacagttacagtacagaactacgggcgcgtcgtaggtagaaaaggggtacgttccaaccgtattccgtaacgaaagagtactaggtaaactttaacgaaaaagtaccttacgaacgttagtaactccgttaggaacaaaagtcgaaaccgacggtacctaaacgggaaaacccggacgggaaccgaaccgggttaccgttaggtttaatttacggttttagggaaacgtaaacgtaaaaggtggttaggaagtttggtaggggttaggtagcttaggggtactaaaccg

SEQ ID NO: 361351 - DNA, 610 bp, Homo sapiens
  misc_feature: GZ8MTXP02H8W54.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggcccgtgggacgggtcccctgagactctcctgtgcagcctctgcattccaccttcagtcgaccacaacatggactgggtcccgccaggctccgaggggaagggctggagtggggtcggccgtattacgaaggaagctaaacagttacagtacagaacgtacggcgtcgtctggtagaaagggaaggttcaacccatctacaaagagatagtaattacaaaagactatacttagtactctagacctaaaatcgaaacgagtaccgtaacggaaaacccgtaagggaaccacgggtacccgttaggtaatttaggttacggtacggtaagaaacgtaaaagaggtaagggaattagggtcgggtaggtacggtcgttaggtacg

SEQ ID NO: 361352 - DNA, 802 bp, Homo sapiens
  misc_feature: GZ8MTXP02JJZ3W.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctctgctattcaccttcagtcgaccaacaacagtcggacgtcgggtcccgccgaaggccctacccggaaggggaacggggtccgtggggtacgggttcggggtaccgggtacccggttaagtttaaccgaaaaggggtaaaagaccttaaaacgtaacggtttaacaaaggttaaaccgaagggtaaacgttaaaccgggggtccgggtaccgttaccggttaagggtaaacggggtaaaaacgggggtaaacgggttttccaaaaccccgtagttacccgtaacgaaaaggtaacgtaagttaggtaaaatttacccgaaaaaaagtaccttaaccgtaaaccgtttggttaactaccgttaaggaactaaaaacgtcgaaaaccgacggtaccctaaaacgggaaaaacccggacgggaacccgtaaccgggtaccgttaggttaaactttaggtttaacggtaagggtaaacgtaaaacgaaaaggtggtaaggtaaccttgggggttacggttaggtacgggtactaggttaaccgg

SEQ ID NO: 361353 - DNA, 661 bp, Homo sapiens
  misc_feature: GZ8MTXP02FU0UA.21.4.A04.1.454.CMB.2.raw
  modified_base (215)..(215): a, c, t, g, unknown or other
  modified_base (262)..(262): a, c, t, g, unknown or other
  modified_base (301)..(301): a, c, t, g, unknown or other
  modified_base (378)..(378): a, c, t, g, unknown or other
  modified_base (385)..(385): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacgttggtccagcctggagggtccctgagactctcctgtgcagcctntgcattcaccttcagtgaccacaacatggactgggtccnccaggctccgaggggaggctggaggtgggtcgcgtattacgaaggaagctaaagagttacagtacagaataccgggngaccgtntggtaagaaagggtaagttcgaaaccctagtactacgaaaaggtagtaagttacgtaaatttaacgaaaaaagaccttaccgaaaccgttagttaacttcctaaggtaaaccaaaagttacgaaaacgtacggaacccgttaaagaaaaacccggggagaaacccggaacgggtacccgttaaggttaagttagtttacggaagggttaccgtaaaacgaaaagggttaaggtaaggtaacggttggtacggggtggttaaggccgttaggtaacg

SEQ ID NO: 361354 - DNA, 873 bp, Homo sapiens
  misc_feature: GZ8MTXP02GVCD5.21.4.A04.1.454.CMB.2.raw
tcagtcgtcgctcgcacgaccggtgctcgatttagagtagtgatcaggggagctctgagagcggagccccagcccagaattcccaggtgttttcatttggtgatcagcactgaacacagaggactcaccatggagtttgggctgagcgttgggttttccttgttgtttattttacaaggtgtccagtgtggaggtgcagctggtggagtcgtgggggagacgttggtccaggccgtgggacgggtccctggagacctcctcccgtggtgcagccctctgctacttccaccttcagtcgaacccacgaaacagtcggaccgtcggggtcccgcccgaagggccgtaccccggaagggggtaaacggggcgtaggggacgggttcgggggtacccgggtaccccggttaaaagtttaaaccggaaaagggggtaaaaacgtacccgttaaaaacgtaaaggttttaaacccgaaaaggttaacccgaagggtaaaaccgttaacccgggggccgtaccgggtttaccgtaggggttaaaggggaaaaaacggggttaaacgggtttacccaaaacccccgtaagttaccccgtaaacgaaaaagggtaaggtaattaacgtaaaacgtttaaacaaaaaacgtaacctaccctaaagtttacggtaactttaccggacgtaaaacctaaaagttaccgaaaaccgacggtaaccgtaaaaccgggaaaaaaccggacgggaaaacctaacccgggggttaaccgtttaggtttaaaattttaacggttagggttaaacgggaaacgtaaaaagaaaacgggtagttaagggaaacggttggttacggggtaggtacggtccggtttaaggtaccg

SEQ ID NO: 361355 - DNA, 796 bp, Homo sapiens
  misc_feature: GZ8MTXP02GEU51.21.4.A04.1.454.CMB.2.raw
  modified_base (297)..(297): a, c, t, g, unknown or other
  modified_base (313)..(313): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtgggacgggtccctgagactctcctgtgcagcctctgctattccaccttcagtcgaccaacaacngtggactcggggtccnccgaggcctaccggaggggaacggggctgggaggttcggggtccggaccgttaagttaacggaaaaggtaaacgtactaaacgtagtttacaaggtaacgaggtaaacgtacggggtccgacgttcgtaggtaaagggaaaagggttacggttaccaacctacgttacgtacgaaaggtaagagttagaaactttaacgaaaacgtaaccttacaaaacgttcgttaacttacgtaacggtaaaactaaaacgtacggaaaacccgttaacgaccccggtaaaaaacgggtaaaaaaccccgggacggggaaacccgtaaacccgggggttacccgttaaaacggggtttttaaaattttaacgggggttttaagggaaaccgggtttaaaacgaaaaacgggttaaaaaaagggtggggttaaggggtaaggtttcggggtaccgggggtttagggtaccggtacggtttacggtaaaccgg

SEQ ID NO: 361356 - DNA, 653 bp, Homo sapiens
  misc_feature: GZ8MTXP02IZH6L.21.4.A04.1.454.CMB.2.raw
  modified_base (303)..(303): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccgtggagggtccctgagactctcctgtgcagcctctgcattcaccttcagtgaccacaacatggactgggtccnccaggctccgaggggagggctggagtggggtcgccgtatacgaaggaagctaaacagttacagtacagaatacggcgcgtcgtagtaggaaaggtaacgttcaaacccgtatcgtaacgaaagagatagtaaattaccgaaaaagtaccttacaaacgttgtaaattccgtagaactaaaaagtcggaaacacggtaccctaaaagggaaaaaccccggagggaaacccgaaccggggtaccgtttaaggttaaagtttaacgtttggggtaacggttaaaacgaaaaacgtaaaaacgggtaggttaaggaaagtttgggtaggggtcggtaaagtcgtttaaggtacg

SEQ ID NO: 361357 - DNA, 704 bp, Homo sapiens
  misc_feature: GZ8MTXP02I3X2K.21.4.A04.1.454.CMB.2.raw
  modified_base (268)..(268): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggttgagcttgggttttccttgttgttattttacaaggtgtccagtgtgaggtgcagctggtggagtcgtgggggatacgttggtccaggccgtgggacgggtccctgagactctcctgtgcagcctntgctattccaccttcagtcgaaccaacaacagtaggaccgtcgggtcccgccgacggccgtaccggaagggggaacggggcctaggggaggttcggggtccggtaccgttaattaaacggaaaggaaacgtactaaacgtagttaacagtaacaagtacgtaccgggcgtaccgtcgtaggtaaggaaaagggtaacggttccaaaccgtatctaacgaaaaggagtaagtacgtaaacttaacgaaaaacgtaacctcgtaaacgttagttactaccgtagacctaaaagtacgaaacgaacgtaccgtaaacggaaaaccggacggaccgaacggttccgttagttaaagttaggtaggtaaacggtaaagtaaacgtaaaaagggtggtaagtaacggttaggttacgggtacggtagtcgtaggtacgaacg

SEQ ID NO: 361358 - DNA, 606 bp, Homo sapiens
  misc_feature: GZ8MTXP02JH01T.21.4.A04.1.454.CMB.2.raw
  modified_base (372)..(372): a, c, t, g, unknown or other
  modified_base (383)..(383): a, c, t, g, unknown or other
  modified_base (387)..(387): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccaggcctgggagggtccctgagactctcctgtgcagcctctgcattcaccttcagtgaccacaacatggactggggtcccgccaggcctccgaggggagggctgggagtggggtcgcgtatacaaggaagctaaacagttacagtacngaaatacggcncgtntgtacgaaaaggtaaggttcaccatctacaaagagatggaattacaaaagactacacttgtaacttcgtagacaaaagtcgaaacacggtaccctaagaaaaacccggagggaaacccgaacgggtacccgttagttaaatttaaggtttggtaagggtaacgaaacaaaaagggagttaaggggaattcgggtagggtaggtacggtactggttaacg

SEQ ID NO: 361359 - DNA, 629 bp, Homo sapiens
  misc_feature: GZ8MTXP02I2BBN.21.4.A04.1.454.CMB.2.raw
  modified_base (359)..(359): a, c, t, g, unknown or other
  modified_base (390)..(390): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctgggggagacttggtccagccgtggagggtccctgagactctcctgtgcagcctctgcattcaccttcagtgaaccacaacatggactcggggtccgccgaggcctccgaggggaaggggctggagtggggtcggccgtattacaaggaanctaaacagttacagtacagaatcggcgctcngtagaaaggagttcaccatactacaagagatagattaccaaaaagtactacaacttaggtaacttcgtacgaactaaaatacggaaacacggtacccgtaaaacggaaaaaccccggaagggaaaccgtaccggtaacccggtagtttaaagtttacgtttaggttaagggttaagaaaaacgtaaaagggaaggttaaggtaaagttgggttaggggtaggtaaccgcgttaggtacg

SEQ ID NO: 361360 - DNA, 710 bp, Homo sapiens
  misc_feature: GZ8MTXP02F7LC7.21.4.A04.1.454.CMB.2.raw
  modified_base (216)..(216): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtgggacgggtccctgagactctcctgtgcagcctctgcattccaccttcagtgaccacaacagtggactggggtcccgccgaggcctaccggaagggggaaggggtccgtggggaggttcggggtccgggaccgtaagttaaccgaaaggggaaacgcgtaaacgagtttaacagttaacaggaactaccggggcgtacgtctgggtaaggaaaagggtaacggtttacaacccgattacgtacaaaggtagagttagtaactttaaacgaaaacggtaacctaactaaccgttaggttaactaccgttaggaaacctaaaagtaccgaaacgaacgacccgtaaacggaaaaccggacgggtaaaccgaacccggggtaccgttaggttaagtttacgttaggttaacggtaagaaaaccgtaaaaggtaggtaaggtaagtacgggttacgggttaggtaacggtcgttaggtaaccg

SEQ ID NO: 361361 - DNA, 568 bp, Homo sapiens
  misc_feature: GZ8MTXP02F5JZL.21.4.A04.1.454.CMB.2.raw
  modified_base (305)..(305): a, c, t, g, unknown or other
  modified_base (354)..(354): a, c, t, g, unknown or other
  modified_base (359)..(359): a, c, t, g, unknown or other
  modified_base (375)..(375): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttgggtccagcctgggagggtccctgagactctcctgtgcagcctctgcattcaccttcagtgaccacaacatggactggggtccnccaggctccgaggggaggggctggaggtgggtcgcgtatacgaaggaanctaanagttacagtacagaanacggcgcgtctaggtagaaaaggaagttttttacgaccatactacaagagatagtaattacaaaagaactacactagtatactagacaaatagaacacgaccgtaacgaaaccgaacgaacgacggacgtacgtattagttagtaggtacgaacgaaagaagtaaggagtaggtaggtaggtagcgtagtacg

SEQ ID NO: 361362 - DNA, 691 bp, Homo sapiens
  misc_feature: GZ8MTXP02IYEBP.21.4.A04.1.454.CMB.2.raw
  modified_base (382)..(382): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccaggcctgggagggtccctgagactctcctgtgcagcctctgctattccaccttcagtcgaaccacaacagtggacgtcggggtcccgccgaggcctccggaaggggaaggggcgtggggaggtcggggtaccggccgtaagtaccgaaaggaaancgtaaacgagttaacagtaacagaatacggcgtcgtcgtaggtaaggaaaagggtacgttccaaaccgtatacgtaaacgaaaggtaagtataggtaaattaaaccgaaaaggtaacccttacgtaaccgttagtaattcgtagaaactaaaagtaacgaaacaacggtaccgaaaacggaaaacccggaagggaacccgacccgggtcgttaagttaaacgtttacgtaggttaaacggggaaaaacaaaacggtaaaaggttggtaaggtaagttggggttacgggtggtaacgtcggttaagtacg

SEQ ID NO: 361363 - DNA, 678 bp, Homo sapiens
  misc_feature: GZ8MTXP02JEX90.21.4.A04.1.454.CMB.2.raw
  modified_base (264)..(264): a, c, t, g, unknown or other
  modified_base (302)..(302): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctntgcattcacttcagtcaccacaacatggactgggtccncaggctcgaggggacggctggagtcgggcgcgtatacgaaggaactctaaacagttacagttaacaggtaacgtacggcgacgttcgtaggtaggaaaacgggtaagttcccaaacccgtagtccgtaacaaaaggagtaactggaaattaaccgaaaaagtaccttacgaacgtttaggtaaactttcgaacggaacttaaaaacgtcggaaaacctacggaaccccgttaaagggaaaaacccccggagggaacccgaacccggggttaccgttaggtttaaaatttacggttaggttaacggggttaaagaaaaaccgtaaaaaggtggtaacggtattacgggttagggacggttaagtccgtagttaaccg

SEQ ID NO: 361364 - DNA, 799 bp, Homo sapiens
  misc_feature: GZ8MTXP02JWJSY.21.4.A04.1.454.CMB.2.raw
  modified_base (216)..(216): a, c, t, g, unknown or other
  modified_base (279)..(279): a, c, t, g, unknown or other
  modified_base (617)..(617): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggttgagctgggttttccttgttgttattttacaaggtgtccagtgtgaggtgcagctggtggagtcgtggggganacgttggtccagccgtgggagggtccctgagactctcctgtgcagcctctgctattcaccttnagtcgaaccacaacagtggacgtcgggtcccgccgaggcctaccggagggggaacggggctaggggaggttcggggtccggtaccgttaattaaccggaaaagggtaaacgtcctaaaacgtacgtttaacgaagtaccgaagaacgttaccgggcggtacggtactagggtaaggaaaacggggtacggtttcccaaacccgtattacctacgaaaaggtagtaatcggtaaactttaacgaaaaacggtaaccttccaaacgttggttaaattccgtagaacctaaaaaggtagaaaacccgtacggtaacccgtaaaagggaaaaaaccccgggngggaaacccgtaacccgggggttacccggtttaaggtttaaaacgtttttacgggtttacgggttaaagggggtaaaaccgttaaaaacggaaaaaaagggttggggtttaaggggtaaagtttacgggggttacgggggtttagggttacggtacccggtttaggggtaacgtaaacccgg

SEQ ID NO: 361365 - DNA, 635 bp, Homo sapiens
  misc_feature: GZ8MTXP02GX53I.21.4.A04.1.454.CMB.2.raw
  modified_base (364)..(364): a, c, t, g, unknown or other
  modified_base (436)..(436): a, c, t, g, unknown or other
  modified_base (445)..(445): a, c, t, g, unknown or other
  modified_base (587)..(587): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctattcaccttcagtcgaccacaacatggactggggtccgcaggctccgaggggaggggctagggaggtcgggcggccgtaattacgaaagggaaacnctaaacgagttaacaggtacagtaaactcgggcacgtctaggtaaggaaaagggtaacgttccaaacccgtntacccgtanaaaagtagatagtaattaacaaaaggtactacacgtttagaacttcgtagacaaaatcggaaacaaggtccctaaaggaaaacccggagacaccgggtaccgttaggttactttagttttacggaaacgaacgtaaaaaggnggttagggaattgggttacgggtaggtaagtccgttaggtaccggaac

SEQ ID NO: 361366 - DNA, 734 bp, Homo sapiens
  misc_feature: GZ8MTXP02GS8HG.21.4.A04.1.454.CMB.2.raw
  modified_base (307)..(307): a, c, t, g, unknown or other
  modified_base (352)..(352): a, c, t, g, unknown or other
  modified_base (357)..(357): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggacgggtccctgagactctcctgtgcagcctctgcattccaccttcagtgaccacaacatggactgggtccncgaggcctcgaggggaggctggagtgggcgcgtatacgaaggaanctaanagttacagttaacagaaactacgggcgtacgtacgtaggtaagaaaacgggtaagtttcccaaacccgtagttaccgtaaccgaaaaggtaacgtaacgtagtaaacgtttaaaccgaaaaacggtaacccttaccgtaaaccgtttaggttaaacttaccgtaacgtaaaccgaaaaagttccggaaaaacgaccgggtaacccttaaaacggggaaaaaaaccccgtacggggaaaacccgtaacccggggtacccggtttaaagtttaaagtttaacggtttaggggttaacgggtaaaacgaaaacgtaaaaagggtagggttaagggaagttaggggttacgggtagggtttacgacgtttaggtaaaccgg

SEQ ID NO: 361367 - DNA, 682 bp, Homo sapiens
  misc_feature: GZ8MTXP02IOMCH.21.4.A04.1.454.CMB.2.raw
  modified_base (314)..(314): a, c, t, g, unknown or other
  modified_base (375)..(375): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggaggtcgtgggggagacgttggtccagccgtgggagggtccctgagacctctcctgtgcagcctctgctattccaccttcagtcgaaccacaacagtaggactggggtcccnccaggcctccgaaggggacggggcgtggaggtggggtccggaccgtattacgaacggaaanctaaacagttacagtacaggaactacggcgcgtcgtggtacggaaaagggtacgttcaaacccgtagtccttaagaaaggtagtatagaattaaaccgaaaaagtactactaacgttagtaattaccgtagaactaaaatccggaaaacgtacgaccgtaaaacggaaaaacccgaggggaaccgaacccgggtaccgttaggtttaaacttgtttaaacggggacggttaaacggaaaaactaaaaaggttcgggaaggtaaagttccggggtagggttacggtaaaggtacgttggtaaaaccgg

SEQ ID NO: 361368 - DNA, 610 bp, Homo sapiens
  misc_feature: GZ8MTXP02HGELJ.21.4.A04.1.454.CMB.2.raw
  modified_base (216)..(216): a, c, t, g, unknown or other
  modified_base (263)..(263): a, c, t, g, unknown or other
  modified_base (287)..(287): a, c, t, g, unknown or other
  modified_base (309)..(309): a, c, t, g, unknown or other
  modified_base (370)..(370): a, c, t, g, unknown or other
  modified_base (435)..(435): a, c, t, g, unknown or other
  modified_base (491)..(491): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtcagtgtgaggtgcagctggtggagtcgtggggganacttggtccagcctgggagggtccctgagactctcctgtgcagcctntgcattccaccttcagtcaaccanaacagtggactcggggtacccncaggcctaccgaaggggaaggggctggaggtgggtccgccgtatacaaaggaaagctaaanagttaacagtaacagaagtacggcgtacgtctggagaaaagggaagttcaaacctatccgtaaanaaagtatacgtagaaattaacgaaacgtaaactaactaactagtactactagtaanaaataacgaaacgaacgaacgaaacgaaaacggaacggaacgaacggtacgtagttagttagtagtagtaacgaaacgaaagaagtaagtagtaggtaggtaggtacgtacgtagtacg

SEQ ID NO: 361369 - DNA, 632 bp, Homo sapiens
  misc_feature: GZ8MTXP02FZGQQ.21.4.A04.1.454.CMB.2.raw
  modified_base (309)..(309): a, c, t, g, unknown or other
  modified_base (352)..(352): a, c, t, g, unknown or other
  modified_base (356)..(356): a, c, t, g, unknown or other
  modified_base (380)..(380): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacgttgggtccagccgtgggaggggtccctgagactctcctgtgcagcctctgctattcaccttcagtcgaccacaacatggactgggtccnccaggcctcgagggagggctggagtgggcgctatacgaagaancaanagtacagtacagaatcggcgcgtntaggtagaaaagggtacgtacaccgatcctagaaagagattagaacttacgaaaagtactacctaattaggtaacttccgtaggaaactaaaagtacgaaacagtacccgtaaaaggaaaacccggagggaaacctaccgggtaccggtttagttaaagtttaacgttacggttaaagggtaaagtaaaaccgaaaaagggttaggtaagggtaagttagggttggggtaaccggtagccgttagggtaacg

SEQ ID NO: 361370 - DNA, 900 bp, Homo sapiens
  misc_feature: GZ8MTXP02I3JGR.21.4.A04.1.454.CMB.2.raw
tcagtcgtcgctcgcacgaccggtgctcgatttagagtagtgatcaggggagctctgagagcggagccccagcccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacgttggtccaggccgtgggacgggtccctgagactctcctgtgcagcctctgctattcaccttcagtcgaacccacaacagtcggacctcggggtcccgccgacgggccgtaccggaagggggtaacggggccgttggggaacgggttcgggggtaccggggtaccccggttaaagtttaaaaccggaaaaggggtaaaaacggtccgttaaaaaccgtaaaggttttaaaccgaaacggttaaaacccgaaggggtaaaaccgtacccgggggtaccggttacccggttaccgttaagggggtaaaggggtaaaaacgggggttaaacggggtttacccaaaccccctaaagttacccgtaaaccggaaaaggaaggtaacgttagggtaaaacttttaaacccgaaaaaacggtaacctttaccgaaacccgttttaggtaacctttccggtaacggaacctaaaaagttaccggaaaaccgacggtaacccggtaaaaacgggaaaaccccgggaaacggggtaacccgtacccgggggtaaccggtttaggtttaaaacgtttttaaagggttaggggtttaaacggggaaaacggtaaaaacgtaaaaagggtaggttaagggggtaaagttcgggggttaagggggttaggttaacgggtccggtttaggttaaaccgg

SEQ ID NO: 361371 - DNA, 613 bp, Homo sapiens
  misc_feature: GZ8MTXP02GZN23.21.4.A04.1.454.CMB.2.raw
  modified_base (199)..(199): a, c, t, g, unknown or other
  modified_base (265)..(265): a, c, t, g, unknown or other
  modified_base (290)..(290): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaancctggccaggcctcccgagttcccnatctatgctcggtcccacgagggcccagtggcccaagtccccgaagtacctacggggtttccaaggttcgggactagggttcggggtcctgggggaccaggtaccttcgacttctcatctattacgcaggactggactccgtaggaagtatttcgacgtaagttgttaattacgttgtacgtagtacgtaagttagtagggtaacgtttcctaccgttcgttcgttaccggttccggaccgtaaacgggaaccgtaaggttaaacgaaagtacggaaaacgtacgtaaggtacgtacgtacggacctaccgtacttcgttacg

SEQ ID NO: 361372 - DNA, 613 bp, Homo sapiens
  misc_feature: GZ8MTXP02IDPBK.21.4.A04.1.454.CMB.2.raw
  modified_base (411)..(411): a, c, t, g, unknown or other
  modified_base (416)..(416): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacttggtccagcctgggagggtccctgagactctcctgtgcagcctctgcattcaccttcagtcgaccaacaacagtggacgtcggggtcccgccgaggcctccggaaggggaaggggcgtggggaggtggggtccggtaccgttagttaacgaaagggaaacgctaaacgagttaacagtacagaatcggcgngtcgngtagaaaggagttcactatctacaagagatagaattaacgaaaagactacacttagtaattcagactaaaatcgaaacacgtaccgaaacggaaaaccgacggaacgaccggtaccggttaagttacttaattaggaggtaagaaaacgttaaaaggaggtaaggaagttaggtgggtacggtacgtcgtgtaacgg

SEQ ID NO: 361373 - DNA, 534 bp, Homo sapiens
  misc_feature: GZ8MTXP02FMRNI.21.4.A04.1.454.CMB.2.raw
  modified_base (278)..(278): a, c, t, g, unknown or other
  modified_base (301)..(301): a, c, t, g, unknown or other
  modified_base (353)..(353): a, c, t, g, unknown or other
  modified_base (460)..(460): a, c, t, g, unknown or other
  modified_base (473)..(473): a, c, t, g, unknown or other
  modified_base (504)..(504): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagccctctgcattcaccttcagtnaccacaacatggactggggtccnccaggctccgaggggagggctgggagtggggtcggccgtatacgaaggaacnctaacagttacagtacagatacgggcgtcgtctaggtagaaaaggtaggttcaacactctacaagagatagattacaaagactcaactgtatcagacaaatgaaacngactagaaaacgngacacggctagtatagtgagtagaacaaagngtaggaatggtaggtgtacgcgtagtgaac

SEQ ID NO: 361374 - DNA, 625 bp, Homo sapiens
  misc_feature: GZ8MTXP02GGVU9.21.4.A04.1.454.CMB.2.raw
  modified_base (308)..(308): a, c, t, g, unknown or other
  modified_base (443)..(443): a, c, t, g, unknown or other
  modified_base (449)..(449): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtccctgagactctcctgtgcagcctctgcattcaccttcagtcgaccacaacagtggactggggtcccnccgaggcctccgaaggggaacggggctggggaggtcggggtccggccgtagttacgaaaggaaagctaaacgagttacaagtaacagaagtacggcgtcgtcgtgtagaaagggtacgttcaacctagtacctanaaaganatagaacttacaaaagtactcgaactgtacttcagaactaaatcgaaacacgacctaaacggaaaaccggaggacgaaccgggtacgttagttaaagtttaacgttagggtacggtaaacgaaaacgaaaagggtgtaagggaagttgggtagggtacggtagtcgtacggtaacg

SEQ ID NO: 361375 - DNA, 689 bp, Homo sapiens
  misc_feature: GZ8MTXP02I5QZO.21.4.A04.1.454.CMB.2.raw
  modified_base (374)..(374): a, c, t, g, unknown or other
  modified_base (380)..(380): a, c, t, g, unknown or other
  modified_base (456)..(456): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagctggtggagtcgtgggggagacccgttggtccagccgtgggagggtccctgagactctcctgtgcagcctctgctattcaccttcagtcgaacccaacaaccagtggactcggggtcccgccacggcctccgaaggggaggggctgggaggtggggtcgccgtattacgaaggaancaaacngttaacagtaacagaaactacgggcgacgttcaggtaggaaaagggtaacgttcaaccctattacgcaaaaggtanagtaggaaactttaccaaaaaggtaccttacgaaccttggttaactcgttacgaacgttaaaaagacgaaacgacgtaaccgtaaacggaaaacccggaacggaaccgtaccggggtaaccgttagtttaagtttaacggtttagggttaacgggttaaacgaaaacggtaaaaggtagggttaacggtaaggttaggggttacggggttaggttacgtcggtttaggtaacg

SEQ ID NO: 361376 - DNA, 775 bp, Homo sapiens
  misc_feature: GZ8MTXP02HG1YK.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagctgggtggaggtcgtgggggagtacgttggtcccaggccgtgggacgggtccctggacgtacctctcctgtgccagtccctctgctattcctaccttcagtacgaacccaacaacctagtcgggaccgtcggggtccccgccgaacgggtcccgtaccggaagggggaacggggtccggtaggggacggggttcggggtaccgggtaccggttaaagttaacgaaacggggaaaacgtaccgtaaacgtagttaaccaaggttaacaggtaaacgtacggggccgtacgttacgtaggtaaagggaaaacgggtaacggttaccaaccgtataccgtaacgaaaaggagtaagtagtaacttaaacgaaaacgtaccttacaacgttagtacttacgtagactaaaagtacgaaaccacggtaacccgtaaacggaaaacccgggaggtaacccgaaccggggttaccgttagttaaagtttacggttagggtaagggtaaacgaaaacgtaaaaagggtgggttaagggtaagttcgggggttaggggttaaggtacgttcggtttacggtaacgg

SEQ ID NO: 361377 - DNA, 685 bp, Homo sapiens
  misc_feature: GZ8MTXP02HKP9I.21.4.A04.1.454.CMB.2.raw
  modified_base (391)..(391): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccaggcccgtgggacgggtcccctggagtacctctcctgtgcagccctctgcattccaccttcagtgacccacaacagtggacctggggtcccgccagggcctaccggaggggaaggggcttggggaggtcggggtccggaccgtaagttaacgaaagggaaacnctaaacgagtttacaagtaacaggaactacgggcgtccgtacgtaggtaaggaaaacgggaacggtttaccaaacccgattaccgtaacgaaaggtaagtattaaggaactttaacgaaaaagtaaccttacaacttaggtaactttccgagtaacaaaagttacgaaacacggaccctaaaggaaaacccgagggaccgaacgggtaccgtagttagtttacgttaggtaggttaaacgaaaacgtaaaaggtagtaaggagttagggtaggtacggtacgtcgttagtaacg

SEQ ID NO: 361378 - DNA, 790 bp, Homo sapiens
  misc_feature: GZ8MTXP02F4KYL.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagccgtgggacgggtccctgagactctcctgtgcagcctctgctacttccaccttcgagtcgaacccaacaacagtcggacgtcggggtcccgccgaggcctccggaagggggaacggggcgtaggggacggggttcggggtccgggtaccgttaaagtttaaccggaaaagggtaaaacggtacctaaaacgtacggtttaaaccaaggttaaccgagggtaaacgtacggggaccgtaccggtacgttaggtaaacggggtaaaacggggtaacggggtttaccaaacccgtaacgtaccgtaacgaaaaggtagtaattacggtaaaatttaaccgaaaaaacgtaccttacgtaaaccgttaggttaactccgttacgaaacctaaaagtacgaaaccgtaacggtaaccccgtaaaaggaaaaaccccgggtaggaaacccggtaacgggtacccgtttaagtttacgtttaacgtttacgggttaacgggtaaaacgaaaacgtaaaaggtaggtaaggtaagtagggttacggggtaggtacgtacgtaggtaacg

SEQ ID NO: 361379 - DNA, 620 bp, Homo sapiens
  misc_feature: GZ8MTXP02IMLWF.21.4.A04.1.454.CMB.2.raw
  modified_base (437)..(437): a, c, t, g, unknown or other
  modified_base (585)..(585): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtgggggagacgttggtccagccgtgggagggtcccctgagactctcctgtgcagcctctgctattccaccttcagtcgaacccaacaaccagtgggactggggtcccgccaggcctccggaggggacggggctggggagtggggtcgcgtatacgaaggaagctaacagttacagtacaggaactacggcgctcgtaggtaggaaaggacgttcaaccctatcctanaaagagtatagacttaacgaaaacgtacctcgtaacttaggtactcgtagaactaaaagtcggaaacacgacccgtaaaggaaaacccggaggaacgaccgggtacgtagttaattagttagggtaacggtaagaaacgtaaaagggngtaagggattgggtgggtagtacggcgtggtaacg

SEQ ID NO: 361380 - DNA, 537 bp, Homo sapiens
  misc_feature: GZ8MTXP02H5688.21.4.A04.1.454.CMB.2.raw
  modified_base (200)..(200): a, c, t, g, unknown or other
  modified_base (288)..(288): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctccaggttcccnatctatcgctgggcccagacgggcccatggcactcccagacacggttcaggtggacaggtggggtctgggggacagaccttcaccgtctacatcattagcaagctggacgcctagaagtattcgcgagttgtattacgtgtacagctagtatggagttcacttctgttcgttcggacctaagggacctaaaaggtaacgaaatacgaaaacgtaacgtggtaggtactacggacctaccgtatcgttcg

SEQ ID NO: 361381 - DNA, 538 bp, Homo sapiens
  misc_feature: GZ8MTXP02HY21D.21.4.A04.1.454.CMB.2.raw
  modified_base (291)..(291): a, c, t, g, unknown or other
  modified_base (306)..(306): a, c, t, g, unknown or other
  modified_base (352)..(352): a, c, t, g, unknown or other
  modified_base (472)..(472): a, c, t, g, unknown or other
  modified_base (510)..(510): a, c, t, g, unknown or other
  modified_base (526)..(526): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacttggtccagcctgggagggtccctgagactctcctgtgcagcctctgcattcaccttcagtgaccacaacntggactcggggtccnccaggctccgaggggagggctggagtgggtcgcgtatacaaggaanctaacagttacagtacagaatacggcgcgtctgtagaaaggagttcacagtctacaaagagatgattacgaaagaactacacttagtattcagacaaatgaaacagactaggaaaaccgngacaacggtctagtattagtgtagtaagaacaaaaggngtaaggatggtacggnggtagctgtacg

SEQ ID NO: 361382 - DNA, 751 bp, Homo sapiens
  misc_feature: GZ8MTXP02FFGZA.21.4.A04.1.454.CMB.2.raw
  modified_base (217)..(217): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgtttattttacaaggtgtccagtgtgaggtgcagctggtggagtcgtggggganacgttggtccagcctgggacgggtccctgacgactctcctgtcgcagcctctgctattccaccttcgagtcgaccacgaacagtcggactcggggtcccgccgaggtccctaccggagggggtaaacgggggcctaggggaggttcggggtccggaccggttaacgttaaacgaaaacggggaaaacgtacctaaaacgaggtttaaaccaaggttaaccaggaaacgttaacgggcggtacgttacttaggtaaggaaaaggggtaaacggtttaccaaaccgtagtacccttagaaaagtagaagttagtaaacgtttacaaaaagaccttacacttaggtacttaccgagaaaccaaagttacgaaaacgtacggaccgtaaacggaaaaaacccggagggttaaccgaaccggggttacccgttagtaaaccgtttttaacgtagggtaaagggttaaaccgaaaacgaaaagggtaggtaagggtaaacctttaggggtgggggttaaccgtacggacggtacggtacg

SEQ ID NO: 361383 - DNA, 707 bp, Homo sapiens
  misc_feature: GZ8MTXP02FPMY4.21.4.A04.1.454.CMB.2.raw
  modified_base (312)..(312): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttccttgttgttattttacaaggtgtccagtgtgaggtgcagctggtggagtcgtgggggagacttgggtccagccgtgggacgggtccctgagacttctcctgtgcagcctctgctattccaccttcagtcgaaccacaacagtggactggggtcccnccgaggcctaccggaggggaacgggctggggagttcggggtacgaccgttaaagttacgaaagggaaatacctaaacgagtttaacagttaaccgagtaaacgtaccgggcgtcgtcgtaggtaacgggaaaaggtaacggttccaaaccgtatacgtacaaagagattagaattacaaaaagtactactaacgttgtaactctagaactaaaagtacgaaacaacggaccctaaaaggaaaacccggacggaaccgtaacccggggtaccgtttaggtttaaactttaggtttacgggtaaacgggttaaacgaaaacggtaaaaagtaggggttaagggtaaacgtttcgggtaacgggggttacggtaaaacggtcgttagggttaaaccgg

SEQ ID NO: 361384 - DNA, 754 bp, Homo sapiens
  misc_feature: GZ8MTXP02F1MO5.21.4.A04.1.454.CMB.2.raw
  modified_base (317)..(317): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtcgcacgcctctgctattccaccttcagtcgaacccacaacagtcggacgtcggggtcccnccgaggcctaccggagggggaacggggtcgtaggggagggttcggggtccgggtaccgttaaagttaacgaaaacgggaaaacgtcctaaaacgtaggtttaaccaaacgttaacgaggaaacgttaccgggcgtaccgtacgttaggtaaagggaaaacgggttaacggttcccaaacccgtagttaccgtaacgaaaggtaagacttaggtaaactttaaaccgaaaaagaccttacgtaacttaggttaactcgtaagaaacctaaaagtaccgaaaacgtacggaacccgtaaaagggaaaaccccggagggaacccgtaacgggtaccgtttagtttaaacgtttagtttacgggaaggtaaacgaaaacggaaaaggtaggtaagggtaaacgttggggttacgggttaggtaacgccgttaggtaacccg

SEQ ID NO: 361385 - DNA, 725 bp, Homo sapiens
  misc_feature: GZ8MTXP02IJFPG.21.4.A04.1.454.CMB.2.raw
  modified_base (262)..(262): a, c, t, g, unknown or other
  modified_base (348)..(348): a, c, t, g, unknown or other
  modified_base (354)..(354): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctggtggagtcgtgggggagacttggtccagcctgggagggtccctgagactctcctgtgcagcctntgcattcaccttcagtcgaccacaacagtggactgggtccgccaggctcgaggggagggctggagtgggcgacgtatacaaggaanctaaangttacagtacaggatacgggcgtacgtcgtggaagaaaagggtacgttcaaaccctatacccttaacgaaaggtacgtaagttaggtaaatttaacccgaaaaagtaccttaacccaacgtttaggttaaacttcccttaggaacctaaaaagttacgggaaaacctacgggaaccccttaaaagggaaaaacccccgggtaagggaaacccggtaacccgggggtaaccgtttaagggtttaactttaaacggtttttagggaaacggggttaaaacggaaaaacggttaaaaagggttaaaggggtttaaggggaaaatttacgggggttccgggggttagggtaacggtttcggtaggggttaaaccg

SEQ ID NO: 361386 - DNA, 630 bp, Homo sapiens
  misc_feature: GZ8MTXP02JLQUV.21.4.A04.1.454.CMB.2.raw
  modified_base (216)..(216): a, c, t, g, unknown or other
  modified_base (266)..(266): a, c, t, g, unknown or other
  modified_base (307)..(307): a, c, t, g, unknown or other
  modified_base (463)..(463): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtgggacgggtccctgagactctcctgtgcagcctcngcattcaccttcagtcgaccaacacagtggactgggtcccnccaggcctccgaggggaaggggctgggaggtgggtcggccgtattacaacggaagctaaacagttacaagttacaggaatacgggtcgcgtcgtgtaaggaaacgggaagttccaacctagtctacgaaagagattagaaattcaaaagtaccttnaaacgttgtaactcctaagggaacctaaaagtaacgaacgaacgaccgtaacggaaaaccggaacggaacgaacggtacccggtacgttagttaacgttaggttacggttaacgaacgaaaagaaggtaaggtagtacggtaggtaggtaacggtcgtaggtaacgg

SEQ ID NO: 361387 - DNA, 627 bp, Homo sapiens
  misc_feature: GZ8MTXP02GCRF8.21.4.A04.1.454.CMB.2.raw
  modified_base (312)..(312): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttattttacaaggtgtccagtgtgaggtgcagctggtggagtcgtgggggagtacgttggtccagccgtgggacgggtccctgacgactctcctgtgcagcctctgctattccaccttcagtcgaaccacaacatggactggggtcccnccgaggcctccgaggggaaggggcgtggaggtcggggtcggaccgtaagttacgaaagggaaagcctaaacgagttaacaagttacagaatacgggacgcgtctaggagaaagggtacgttacacccgtatacgtacaagagatgaacttacgaaaagtactataaaccgtgtaatccgtagaactaaaagtcgaaaaccgtaggaccctaaacggaaaaccgtacggacgaacgggtccgttaagtatttacgtagggtacgtaagaaacgaaaaggtagttggaattgggtacgggtagtagtcgtaggtacg

SEQ ID NO: 361388 - DNA, 636 bp, Homo sapiens
  misc_feature: GZ8MTXP02GS6BM.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctattccaccttcagtcgaccacaacatggacctcggggtcccgccgacggccgtaccgaaggggaacggggcgtggggaggttcggggtacgggcccgtaagttaacgaaaggtaaacgacctaaacgagttaacagttaacagtaactacggcgcgttcgtaggtaggaaaagggtagttaccaaccgtaatcctagaaagagatgtaattacgaaaagtactacacgttagtacttcgtagaactaaaagacgaaagacgtacgtaaacgaaaacccggagaaccgacggtaccgtagttattacgtaggaggtaaagaacaaaaggtaggtaagtacgtagggttgggtagtagtacgttggaaccg

SEQ ID NO: 361389 - DNA, 673 bp, Homo sapiens
  misc_feature: GZ8MTXP02IA0GZ.21.4.A04.1.454.CMB.2.raw
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggacctggggtcccnccgaggcctaccgaggggaacggggcgtgggaggtggggtccggccgtaagttaacgaaaggaaagcctaaacgaggttaacaaggttaacagaacgtacggaccgtcgtcgtaggtaggaaaagggtagttaccaccgtaatcctacgaaagagtagtagtaacttaaacaaaagtaacttacgaactttggtaacttcgtaggaacctaaaagtacgaaaacacgtaccgtaaacggaaaaacccggagggaaacccgaacccggttaccgggttagtttaaagttacgtttagggaacgggttaaagaaaacgtaaaaaggtggtaagggaagttgggtcgggtaggttacggcgttacggtacg

SEQ ID NO: 361390 - DNA, 585 bp, Homo sapiens
  misc_feature: GZ8MTXP02JR5GE.21.4.A04.1.454.CMB.2.raw
  modified_base (336)..(336): a, c, t, g, unknown or other
  modified_base (358)..(358): a, c, t, g, unknown or other
  modified_base (440)..(440): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcgccatggagtttgggctgagctgggttttccttgttgttattttacaaggtgtccagtgtgaggtgcagctgggtggagtcgtgggggagacgttggtccagccgtgggacgggtccctggacgactctcctgtgcagcctctgcattcaccttcagtcgaccacaacatggactgggtcccgcgaggcctccgaggggaagggctggngtgggtcgcgtatacaaggaanctaaacagtacagtacagaaatacgggcacgtcgtagtacgaaagggtaacggttccaaccagtctacaagagatgaataanaaagaactcactgaatctagacctaaaatcgaaacagaccgtaagaaaaccgaggaacgacggtaccgttagtaacgttagtttaggaaggtaaagaaacgtaaaagaggaaggtagtaggggtcgtaggtacgtcgtaggtacg

SEQ ID NO: 361391 - DNA, 747 bp, Homo sapiens
  misc_feature: GZ8MTXP02F8CJI.21.4.A04.1.454.CMB.2.raw
  modified_base (269)..(269): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagccgtgggacgggtccctgagacctctcctgtgcagccctntgctacttccaccttcagtcgacccaacaacagtcggacgtcggggtccccgaccgaggccctaccggaagggggaagggggccgttaggggacggggttcgggggtccgggacccggtttaaattaaccggaaaaggggtaaaactaccgttaaaacgtaaacggtttaaccgaaaaggttaaccgaagggtaaaacgttacccgggggccgtaccgggtttaccgtaaggggttaaagggaaaaaacgggggtaacgggtttacccaaacccgtaagttaccgtaaaccgaaaggtaaagattaggtaaactttaacgaaaaacgtactaccgtaaaccttggtaacttcgtagaacctaaatacgaacgagaccctaaagaaaccggtagaccgacggtcttagttattacgttggtaggtacgaaacgtaaaggtagtaagggtaatagggtcgggtaggtacgcgtacgtacg

SEQ ID NO: 361392 - DNA, 675 bp, Homo sapiens
  misc_feature: GZ8MTXP02GSPI8.21.4.A04.1.454.CMB.2.raw
  modified_base (553)..(553): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtggaggtgcagctggtggagtcgtgggggagacgttggtccagccgtgggagggtccctgagactctcctgtgcagcctctgctattccaccttcagtcgaaccacaacagtggactcggggtcccgccgaggcctccggaagggggacggggcgtagggaggttcggggtccggtaccgtaagttaaccgaaagggaaacgtacctaaacgaagttacaagttaacaggtaaacgtacggggcgcgttcgtaggtaagggaaaagggtaacggttacaaccctataccgtagaaagagtaatagtaaacttaacaaaaagtacctacctaagttacgtaattccgagaacctaaagaccgaaaanaccggactaaacggaaaacccggaggaccgtacggtaccgttagttaactttaggttaggtaggttaaacgaaaacgaaaaggtaggtaagtagtaggtagggtacggtagtcgtaggtacg

SEQ ID NO: 361393 - DNA, 704 bp, Homo sapiens
  misc_feature: GZ8MTXP02JUGV4.21.4.A04.1.454.CMB.2.raw
  modified_base (315)..(315): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgcattccaccttcagtcgaaccacaactagtcggacgtcggggtcccnccgaggcctccggaaggggaaggggctaggggaggtcggggtcgccgtaagttacgaaaggaaagtctaaactagttacaaggttacagaactacgggccgacgtctggtaaggaaaagggtacgttccaaacctagttcctaacgaaagtagagttacgaattaaccaaaaagtacctactaacgttagtacttccgtaggaacctaaaagtcgaaaacgacggtaaccaaacgggaaaaacccccggaggaaacccggtaaccgggtacgttaaggttaaagttttacggttaacggggttaacggggttaaacgaaaaccggttaaaaaaggggtaggttaacggtaggttaggggttagggttacgggtacgtcgtacggtaacg

SEQ ID NO: 361394 - DNA, 588 bp, Homo sapiens
  misc_feature: GZ8MTXP02GXK8W.21.4.A04.1.454.CMB.2.raw
  modified_base (352)..(352): a, c, t, g, unknown or other
  modified_base (479)..(479): a, c, t, g, unknown or other
  modified_base (550)..(550): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgacccacaacagtggactggggtcccgccaggctccgaggggagggctggagtgggtcgcgtatacgaaggaanctaaacagttacagttaacaggtaatacgggcgcgttcgaggtaggaaaagggtaggttcaaaccgtatcctacaaagagatagaattacaaaagtactacactagtatctagacaaagtcgaaacngacctaaggaaaacccgaggaccacgggccgttaggtaattagttaggtagggtaagaaaccgtaaaaggnggtaaggtaagtggtacgggtaggtagcgttagtaacg

SEQ ID NO: 361395 - DNA, 705 bp, Homo sapiens
  misc_feature: GZ8MTXP02JAWZ9.21.4.A04.1.454.CMB.2.raw
  modified_base (201)..(201): a, c, t, g, unknown or other
  modified_base (294)..(294): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatactccagacgctactacatacgcctaggtaccagcagaagcctggccaggcctccaggttccnatctatgctcgggtccccagacgggcccacgtcgggaccactccccgaaaggaccgtacggggtttccaagggttcggacgtagggttcggggtctgggggaacctaggtacctttccgaccttctacgaattacctaagtttaacgcgtaaacggtacgtacgggtaacgtcccgttaggtaacgtaacgtttaccggacgttaaggttacggtttaactttaacgttgttaccgtagtaccgtaagttaagttaacgggtaacgtttaccgaccgtttacgttcggtttacccggtttacggacccggtaaaacgggggtaaccctaaaagttaacggtaaacgtaaaacgttaacggaaaaccgtaacgttacggtacggtacgtacggacctaaccgtactttaccg

SEQ ID NO: 361396 - DNA, 614 bp, Homo sapiens
  misc_feature: GZ8MTXP02G3GRJ.21.4.A04.1.454.CMB.2.raw
  modified_base (202)..(202): a, c, t, g, unknown or other
  modified_base (295)..(295): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagacgctactacatagcctggtaccagcagaagcctggccaggcctcccgaggttccctnatctatgccgttcgggcccacgacgggcccacgtggccatccccagacgacggttcagtggctaggtcggtctgggggacaggaccttcgacttctcatctattacgcagactggacgccgtagaacgtagttcgactagtagttaacttacgtgtccagtacgtaagttagtagggtaacttcgtaccttcgttacggttccggttacgggtaacccgaaacggggtaacccgtaaagggttaaacggtaaaacgtaacgtaaaaccgtaacgtaaggtacggtacgtacggacctaaaccggtcgtttactttccgg

SEQ ID NO: 361397 - DNA, 860 bp, Homo sapiens
  misc_feature: GZ8MTXP02I1SWW.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgtttattttacaaggtgttcagtgtgaggtgcagctggtggagtcgtgggggagacgttggtccaggccgtgggagggtcccctgagtacctctccgtgtgcagcctctgcattcacccttcaagtcaacccaacaacagtcgggacgtcggggtaccccgccgaacgggcctacccggaaggggggaacggggtccgtaggggacgggttcggggtaccgggtacccggttaaagttaaccggaaaaggggtaaaacgtaccttaaaacgtaacggtttaaaccaaggttaaccgaagggtaaacgttaccggggaccgtacgttacgttagggtaagggaaaacggggtaaacgtttcccaaaaccctagttacccgtaacggaaaaggtaagtaacgttggtaaaactttaacccgaaaaaacgtaaacccgtttacaaaccgtttaggttaacctttaccggtaacgaaaacccttaaaagtacccggaaaaccgtaaccgaacccgttaaaacgggaaaaaacccgggtaccggggaaaccgtaaacccgggttaccggtttaaaggttaaaccttttaaacgggttcggggttaaaggtaaacggaaaaccgttaaggggaaaacggttaagggttacggggtaagttacggggtttaccgggggtaggttaacggggtacctttgggg

SEQ ID NO: 361398 - DNA, 687 bp, Homo sapiens
  misc_feature: GZ8MTXP02HSJM6.21.4.A04.1.454.CMB.2.raw
  modified_base (309)..(309): a, c, t, g, unknown or other
  modified_base (501)..(501): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggagggtccctgagactctcctgtgcagcctctgcattccaccttcagtcgaccaacaacagtggactggggtcccnccgaggcctccggaggggaagggctggggagtggggtcgaccgtaataacgaaggaaatctaaacgagtttaacagtaacaggaaacgtccggacgtccgttacgtggtaaagaaaagggagttaccaacccgtatactacgaaagagatagaattacaaaacgtactactaaccttagttacttacgtaanaacgtaaagtacgaaacgaacgtaaccgtaaacggaaaaccggacggaaccgtaccggttaccgtttaggtttaaagtttacggtttaagggttaaacggtaaacggtaaaacggtaaaagggttagggtaaggttaaggttacgggggtttacggggttaggttacggttacgttaacggtaacg

SEQ ID NO: 361399 - DNA, 712 bp, Homo sapiens
  misc_feature: GZ8MTXP02HOLB7.21.4.A04.1.454.CMB.2.raw
  modified_base (319)..(319): a, c, t, g, unknown or other
  modified_base (614)..(614): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagtacgttggtcccagccgtgggacgggtccctgacgtactctcctgtgcagcctctgctattccaccttcagtcgaaccacaacagtggacgtcggggtcccnccgaggcctaccggaagggggaacggggtctggggacggtcggggtccggaccgttaagttaacgaaagggtaaactctaaacgtacgtttaacaaggttaacagggtaaactaccggggcgtaccggttacgtaggtaaagggtaaaaacgggtacgggtttccaaacccgtagttaccgtaacgaaaagtaggtataaggtaaacttaaccgaaaaagtaccttcgtaaacttggtaacttacgtagaaactaaaatcggaaaacctacggaaccgtaaacggaaaaacccgngggaacctaacggggtacttaggttaattacggttaggtaaggtaaacgaaaacgaaaaggtggtaagtagttaggtaggtggtacgcgtttagaccg

SEQ ID NO: 361400 - DNA, 928 bp, Homo sapiens
  misc_feature: GZ8MTXP02IGQYP.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtggaggtgcagctgggtggagtcgtgggggagtacgttggtccagcctgggacgggtccctgagactctcctgtgcagcctctgctattccaccttcagtcgaccaacaaacagtggaccgtcggggtcccgaccgagggccgtaccggaagggggaacggggcttaggggaacggtcgggggtaccggaccggttaaagttaaaccggaaaaggggaaaagtaccctaaaacgtaaggtttaaacaaggttaaccaaggtaaaacgttacggggacccgtaccggttacgtacgggtaaaagggaaaacggggtaaacggtttaccgaaaccctaacgtaccgttaaccgaaaacggtaaggtaaacgttaaggtaaacgtttaaacccgaaaaaacggttaaaccttaaacccgtaaaccgtttaggttaaactttaccgttaacgggaaacctaaaaacgttaacggaaaacccgtaaacgggtaaaccccgttaaaaccggggaaaaaaaccccgggtaaccggggaaaaccccggtaaaaccccgggggttaccccggtttaaaacgggttttaaacggttttaaacggttttaaacggggttaaacgggggttaaaacgtaaaaaccgggtaaaaaaaggggttaacggggttaaacgggggttaaaaggtttacgggggtttacgggggttaaacggggtttacggttaacccgggtttaagggttaaacccggg

SEQ ID NO: 361401 - DNA, 529 bp, Homo sapiens
  misc_feature: GZ8MTXP02FLFR3.21.4.A04.1.454.CMB.2.raw
  modified_base (202)..(202): a, c, t, g, unknown or other
  modified_base (291)..(291): a, c, t, g, unknown or other
  modified_base (397)..(397): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccagttccnatctatgctcggtcccacgagggcccacgtggccatccccagtcaggttcagtggcaggtgggtctggggacagtacttcgactctcatcattagcagactggacnccgtgaagtattacgctaggttagtattactgtacagcaagtataggaattcgactcgtcgtcgttcggacgaagggactaaagggtacgaaagtagaaacgtagtaagtcggacgtacgacactatctacg

SEQ ID NO: 361402 - DNA, 669 bp, Homo sapiens
  misc_feature: GZ8MTXP02GIN1Y.21.4.A04.1.454.CMB.2.raw
  modified_base (203)..(203): a, c, t, g, unknown or other
  modified_base (300)..(300): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccacctctcctgcagcctccagccagaatactccagagctactacatagccctaggtaccagcagaagccgtggccaggcctccctaggttcccnactctatcgcgtcggtcccagcgggccagtggacactcccagactcggtcagtgcaggtcggtctggggacaggaccttcgactctacatctagtacgcagctaggactacgtagaacgttagtttcgacgttaggttacgttaagtttaccgttaggttaccaagggtacctaagggtttaaagttacggggttaaaactttcccgtaacccgtttacggtttcgggttacccggtttacccgggaaacccggtaaaagggggtaaacccgtaaaaggggtaaacgtaaaacggtaaaccggtaaaacggttaaaccggttggttaccgggaacttacggaacctacccggtaagtttctttaaccgg

SEQ ID NO: 361403 - DNA, 718 bp, Homo sapiens
  misc_feature: GZ8MTXP02HE8MY.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggaggtcgtgggggagtacgttggtccaggccgtgggacgggtccctgagactctcctgtgcacgcctctgcattccaccttcagtcgaccaacaacagtcggacgtcggggtcccgccgacggccgtaccggaggggaacggggcgtaggggtaggtcggggtccgggtaccggttaagttaacggaaacgggaaaacgtacgtaaacgtacgttaacgaagtaacacggtaaacgtacggggccgtacgttacgtaggtaaacgggtaaaagggtaacggtttaccaaacccttagtaccgtacgaaagagtaatagttaaacgttaaaccaaaaggtaacctacgtaacgttagtactacgtacgaaactaaaagtacgaaacacgtacccgtaaaaggaaaccggtacggaacgacccgggtaccgttaggttaaatttacggttaggtaagggtaaacgaaaacgaaaaggtaggtaaggttaagtgggttaggtggtagtcgtagtacg

SEQ ID NO: 361404 - DNA, 611 bp, Homo sapiens
  misc_feature: GZ8MTXP02FRDX4.21.4.A04.1.454.CMB.2.raw
  modified_base (303)..(303): a, c, t, g, unknown or other
  modified_base (599)..(599): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggaggtctggggggagacttggtccagcctgggagggtccctgagactctcctgtgcagcctctgcatcacttcagtcgaccacaacatggactggggtccnccaggctccgaggggaagggctgggaggtggggtcggccgtaagttaccgaaaggaaacgctaaacgagtttacagttaacagaaatacgggcgacgtcgtagtaggaaaaggtaaacgggttcaacccgatctacaaagagatagaattacaaaaagactacgacttgactcagtacaaaatgaaacacgtaccaaagaaaaccggaggaacgaaccggacgttagttacgtttagtaggttaggtaagtaaaacgaaaaggtggtaaggtaaagttggtagggtaggtaaccgnggttaggtaacg

SEQ ID NO: 361405 - DNA, 669 bp, Homo sapiens
  misc_feature: GZ8MTXP02FHK1L.21.4.A04.1.454.CMB.2.raw
  modified_base (216)..(216): a, c, t, g, unknown or other
  modified_base (262)..(262): a, c, t, g, unknown or other
  modified_base (311)..(311): a, c, t, g, unknown or other
  modified_base (501)..(501): a, c, t, g, unknown or other
  modified_base (655)..(655): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgagctctcctgtgcagcctntgctattccaccttcagtcgaacccaacaacagtcggactcggggcccnccgaggcctaccggaggggaagggctgggacggttggggtccgacgttaataacgaaaggaacgctaaagagttaacagtaacagaacgtacggcgcgttactaggtacggaaaagggtacgtttaccaaccgtaatcctagaaaggtagattaggtaacttacgaaaaacgtactaccacgtagttacncgttagaacctaaaagtcgaaactacgacccgtaaaggaaaaacccggtaggaacccaaccgggtaccgttagttaaagtttacgtaggttaacgggtaaacgaaaacgaaaagggtaggtaaggtaaagtggggttaaccgggttagggtaanccggtagtaaaccg

SEQ ID NO: 361406 - DNA, 587 bp, Homo sapiens
  misc_feature: GZ8MTXP02IDYEP.21.4.A04.1.454.CMB.2.raw
  modified_base (279)..(279): a, c, t, g, unknown or other
  modified_base (311)..(311): a, c, t, g, unknown or other
  modified_base (378)..(378): a, c, t, g, unknown or other
  modified_base (408)..(408): a, c, t, g, unknown or other
  modified_base (444)..(444): a, c, t, g, unknown or other
  modified_base (508)..(508): a, c, t, g, unknown or other
  modified_base (543)..(543): a, c, t, g, unknown or other
  modified_base (554)..(554): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcttgttgttattttacaaggtgtccagtgtgaggtgcagctgggtggaggtcgtggggggagtacttggtccagcctgggagggtccctgagactctcctgtgcagcctctgcattcaccttnagtcgaaccaacaacatggactcggggtcccnccgacggctccggaaggggaaggggctggggagtggggtccggtaccgtaataacgaaagggaaacnctaaacagttaacagtacagaatacgggcncgtctaggagaaaggagttacaccgatcacaaaganatgaatacaaaagtactacactagtatctagaacaaatcgaaacacgacctaacggaaaaccgngaaccgacggtacgtagttattattaggaggtaanaacgtaaaagngtaagagtaggtgggtaggtacgacgtagtacg

SEQ ID NO: 361407 - DNA, 588 bp, Homo sapiens
  misc_feature: GZ8MTXP02I1O36.21.4.A04.1.454.CMB.2.raw
  modified_base (355)..(355): a, c, t, g, unknown or other
  modified_base (382)..(382): a, c, t, g, unknown or other
  modified_base (463)..(463): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttgggtccaggcctgggagggtccctgagactctcctgtgcagcctctgcattcaccttcagtcgaaccacaacatggactggggtccgccaggcctcgaggggagggctggagtgggtcgcgtatacgaaggaanctaacagttacagtacagaatacggcncgtctagtagaaaggtagtcaccatctacaagagatagattacaaaagactacacttagtatctagactaaaatcgaaacncgtaccctaaaggaaaacccgaagggacaacgggtacccgttagtaactttagtggtaaggtaacgaaaacgaaaagtaggtaacgggtaagttgtacgggggttaggtacggcgttaggtaacg

SEQ ID NO: 361408 - DNA, 649 bp, Homo sapiens
  misc_feature: GZ8MTXP02GBMMT.21.4.A04.1.454.CMB.2.raw
  modified_base (264)..(264): a, c, t, g, unknown or other
  modified_base (351)..(351): a, c, t, g, unknown or other
  modified_base (356)..(356): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctntgcattcaccttcagtcgaccacaacatggactgggtccgcgaggctccgaggggagggctggagtgggtcgcgtatacgaaggaanctaanagttacagtacagaactacggcgcgtctaggtagaaaaggtacgttcaaccgtatacgtacaaagagattagaacttacgaaaagtactactaacgttaggtaacttcgtagaactaaaagttcgaaaacgacggtaccccgtaaaagggaaaaccccggaggggtaacccgaaaccggggtacccgttaagttaacgtttaagttagggtaaggttaaaacgaaaaccgtaaaaagggtaggttaagggtaaagttggggtacggggttaggtaacgtccgttaggtaaccg

SEQ ID NO: 361409 - DNA, 740 bp, Homo sapiens
  misc_feature: GZ8MTXP02FMXQO.21.4.A04.1.454.CMB.2.raw
  modified_base (262)..(262): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccagtccgtggacgggtccctgacgactctcctgtncacgcctctgcattccaccttcagtcgaccacaacagtggacgtggggtcccgccgaggcctaccggaggggaaggggcgtggggtacgggttcggggtaccggaccggttaaagttaaaccggaaaacggggaaaacgtaccgtaaaacgtaacggtttaaaccgaaacggttaaccgaaggaaacgttaccgggggcgtaccggtacgttagggtaagggaaaacggggtaaacggtttccgaaaccctactaccgtaacgaaagaagtaagttaggtaaatttaacgaaaaaacgtacctaacgtaacgtttagttaacgtactaggaaacctaaagtacgaaactaacgaccgtaaacggaaaaccggacggaacgaccggtacggttagtaacgtttaggttaggtaagtaaacggaaaacgtaaaaggaggtaaggtagtagggttagggtacggtaagtcgttaggtaacg

SEQ ID NO: 361410 - DNA, 687 bp, Homo sapiens
  misc_feature: GZ8MTXP02HPME9.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagtacgttggtccagccgtgggacgggtccctggacgactctcctgtgcagcctctgcattccaccttcagtcgaaccaacaacagttcgggactcggggtccccgccgaaggccctaccggaagggggaaacggggccgtaggggacggtggggtccggtaccgtaagttaacgaaaggaaaacgactaacgagttaacgagtaacagaaagtacggcgcgtcgtaggaagtaaaagggaacgtttaccgaaaccctagtcctaacgaaagtagaagtagtaacttaacgaaaagtaaactactaacttacgtacttacgtagaaacctaaaagtacgaaaaccgacgaaccgtaaacggaaaaacccggaggaaaccgaaccgggtaccgtaagtttaattaacgttggtaacggttaaaacgaaacgaaaaaggtggtaaggagtaggtggtacggtagcgtagtaacg

SEQ ID NO: 361411 - DNA, 598 bp, Homo sapiens
  misc_feature: GZ8MTXP02F9P06.21.4.A04.1.454.CMB.2.raw
  modified_base (202)..(202): a, c, t, g, unknown or other
  modified_base (293)..(293): a, c, t, g, unknown or other
  modified_base (380)..(380): a, c, t, g, unknown or other
  modified_base (442)..(442): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctaactacatagcctaggtacagcagaacgctcggccagcctccgaggttccncatctatgctcgggtcccacgacggcccactggccactccgagacgacggttcaggtggcaggtgggtctggggacagacttcactntacatctaagttagctaagacgtgggagccgtagaaagtactttcgactagtgttattacgngtacaggtactaagtagtaggtaaacgtttcgaccgttcgttggttccgggttaccggaaccgaaaacggggtaacccgtaaaagggtaaagtaaaacgtacgggtaaaaccgtaacgtaaggtacggacgttacgactaaccgtacttcgttacg

SEQ ID NO: 361412 - DNA, 726 bp, Homo sapiens
  misc_feature: GZ8MTXP02ILD4K.21.4.A04.1.454.CMB.2.raw
  modified_base (630)..(630): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcggtagggggagtacgtttggtccgaggccgtgggacgggtccctaggacgtacctcctccgtggtcgcacgtcctcgtgcctacttccaccttcgaggtcaaccaacaacgtagtacggacgtccggggtcccgaccaacggccgtacccggaagggggaacggggtcggtaggggtagggtcggggttacccgggaccggtttaaacgtttaaacggaaaaacggggtaaacgtaaccgtaaaacgtaacggttaaacgtaacgtaaaccgaggtaaaacggttacgggaccggtacgttcgtaaggtaaagggtaaaaacgggtacggttacccaaaccgtatccgtaagaaagtagtaagtaagtaacttaacgaaaaacgtactaccgtagttaggtacttacgaagtaccgaaaaanaacgaacgaacgacgaaacgaaacgaacgacgacgtacgtagtagttagtagtagtacgaacgaagagtaagtagtagtaggtagtagcgtagtag

SEQ ID NO: 361413 - DNA, 720 bp, Homo sapiens
  misc_feature: GZ8MTXP02H2OCH.21.4.A04.1.454.CMB.2.raw
tcagtcgtcgctcgcacgaccggtgctcgatttagagtagtgatcaggggagctctgagagcggagcccccagccccagaattcccaggtgttttcatttggtgatcagcactgaacacagaggactcaccatggagtttgggctgagctgggttttccttgttgttattttacaaggtgtccagtgtgaggtgcagcgtggtggaggtcgtgggggagacttggtccagccgtgggacgggtccctgagactctcctgtgcagcctctgctacttccaccttcagtcgaacccacaaacagtggacgttcggggtcccgcccgaagggccgtaccggaagggggaaggggctggggaggtcggggtccgccgttaattaacgaaaggaaacgctaaacgagttacagttaacagaaacgtacggccgtacgtcgtagtaggaaaagggtaacggtttacacctagtacgtaacaaagggtaaactagtaggtaaatttaaccgaaaagtaaacctacctaacttaggttacttacctaggaaacctaaaagtacgaaaccacggaccctaaaagggaaaaaccccggtaggaaaccgtaacccgggtaccgttaaggttaacgttttaacgttaggttaacggtaaaggaaaacgtaaaaagggtaggttaaggtaagttaagggggtgggttaaccgggttacgacggtttaggaacg

SEQ ID NO: 361414 - DNA, 514 bp, Homo sapiens
  misc_feature: GZ8MTXP02G7CZC.21.4.A04.1.454.CMB.2.raw
  modified_base (304)..(304): a, c, t, g, unknown or other
  modified_base (489)..(514): a, c, t, g, unknown or other
tcagtcgtcgctcgcacgaccggtgctcgatttagagtagtgatcagggggagctctgagagcggagccccagccccagaattcccagggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtcccncagctcgagggagggctggagtgggtcgccgtaataacgaaaggaaagctaaacagttaacagttaacagaaacgtacggcgcgtctggtaggaaaaagggtaacgttacaaacctaatactacgaaagaagaatagtaataactaaaacgaaaactactaactagttacttactacgtacaaannnnnnnnnnnnnnnnnnnnnnnnnn

SEQ ID NO: 361415 - DNA, 760 bp, Homo sapiens
  misc_feature: GZ8MTXP02HKNDR.21.4.A04.1.454.CMB.2.raw
  modified_base (340)..(340): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagcgtgggtggagtcgtgggggagtacgttggtccaggccgtgggacgggtcccctggacgtacctcctcctggtcgcctagccctctgactacttccaaccttcaacgtcgaacccaacaacagtgggaccgtcggggtcccnccgacggccgtaccggaagggggacggggtcgtggggaggttcggggtaccggtaccgttaaagtaaccgaaagggtaaacgtactaaacgtaagttacaaggttacaaggtaacgttacgggcgtaccgttagtaggtaaacgggtaaaagggtacgtttccaaacccgtattacccgtaaagaaagaaacgttagtaacggtaaactttaaaccgaaaaaacgttaccttaccggtaaacttttaggtaacttttacgaaacggaaaccttaaaaagtccggaaaaccgtacgtaaccgttaaaacgggaaaacccgtgggaaacccgtacccggtacgttagtttaatttacggttagggtaagtaaacgaaacgtaaaaggtggtaaggattgggtaggtagtagcgttaggtaac

SEQ ID NO: 361416 - DNA, 769 bp, Homo sapiens
  misc_feature: GZ8MTXP02IZ3B9.21.4.A04.1.454.CMB.2.raw
  modified_base (714)..(714): a, c, t, g, unknown or other
  modified_base (727)..(727): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgctattccaccttcagtcgaaccccaacaaactagtacggaccgtcggggtccccgaccgaggcccgtaccggaagggggaacggggtcgtaggggtagggttcggggtaccgggtacccggttaaagttaaccggaaagggaaaacgtacctaaacgtaagttaacaaggttaaaccagggtaaacgtaaccggggcgtaccggttacgttaggggtaaaggtaaaaaggggtaacggtttacccaaacccgtagtaacccgttaacggaaaaggtagtagttaagtaacgtttaaaacaaaaacggtaaccttaacctaaaccgtttacgttaaagtttacctacggaaactaaaattaacgggaaacctaaggaccccgtaaaagggaaaaccccgagggaaccgtaccggggtactaggtttaattaggttagtacggtaaanaaacgtaaaaggngtaaggtaagtagggttaggtacgtaacgcggttagtaacgg

SEQ ID NO: 361417 - DNA, 686 bp, Homo sapiens
  misc_feature: GZ8MTXP02JGYWG.21.4.A04.1.454.CMB.2.raw
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgacgactctcctgtgcagcctctgcattccaccttcagtcgacccacaacagtggactcggggtcccnccgaggcctccggaaggggaacggggccgtggggaggtcggggtccggccgtaagttaacgaaaggaaagctaaacagttacaagtacagaagtaacggcgtcgtctaggtaggaaaaggtacggttccaaacccgtatacctacgaaagagaattacgtaaattaccaaaagtacttacgaaacttgttaaactcgtacgaactaaacgtagaaacccgagaccccgtaaaggaaaaacccgggtagggaccgtaacccgggggtaccgttaaggttaaatttaacggtttaggggtaaacggttaaggaaaaacgtaaaagggtagggtaaggttaagtcggggttaggggtaggtagtaccggttggtaaccg

SEQ ID NO: 361418 - DNA, 620 bp, Homo sapiens
  misc_feature: GZ8MTXP02HYG0Q.21.4.A04.1.454.CMB.2.raw
  modified_base (308)..(308): a, c, t, g, unknown or other
  modified_base (509)..(509): a, c, t, g, unknown or other
tcagtcgtcgctcgcacgaccggtgctcgatttagagtagtgatcaggggagctctgagagcggagcccccagccccagaattcccaggtgttttcatttggtgatcagcactgaacacagaggactcaccatggagtttgggctgagctgggttttccttgttgttattttacaaggtgtccagtgtgagtgcagctgggtggagtcgtgggggagacttggtccagcctggagggtccctgagactctcctgtgcagcctctgcacttcacccttcagtgacccacaacatggacctggggtcccnccaggcctccgaggggacgggctggagtgggcggccgtataacgaaggaaagctaaacgagttacagtacagaactacggcgcgtctgtaggaaaagggaacggttcaaccctatctacaaaggaagatagaacttacgaaaagtactacacttgtaattccagaactaaatcgaaaacagaccctaaggaaaaacccggngggtaaacaacccgggacgttaggttaattagtttcgggaaggttacgaaaacgtaaaaaggagtaacggggtagttagggttacgggtagggttaagtcgttaggtaacg

SEQ ID NO: 361419 - DNA, 870 bp, Homo sapiens
  misc_feature: GZ8MTXP02HZEHM.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgtttgttattttactaaggtgtccagtgtgaggtgcagcgtggtggagtcgtgggggagacgttggtccagccgtgggacgggtccctggacgtactctcctgtcgcacgcctcgtgctacttccaccttcagtcgaaccacaactagtcggactcggggtcccgccgacggtccgtccggaaggggaacggggcgtaggggtacggttcggggtccggtaccggttaaagtttaaccggaaaaggggtaaaacgtacccgttaaaacgtaacggttttaacgaaacggttaaacgaacggggtaaacgttaaccggggaccggtacccgtttaggttacggggtaaaacgggtaaaaacgggggttaacgggttttacccaaaccccgtaagttaccgttaaccggaaaaaggtaagttaacgttaggtaaaactttaaaaccgaaaaaacggtaaccctttaaaccgtaccgtttaaaggtttaacttacccttaagggaaacccttaaaaagtaccgaaaaccgaccgggtaaacccgttaaaaccggggaaaaaaaccccggagggtaaacccccggtaaccggggttacctttaaggttttaaacgtttacggtttaagggtaaaccggttaaaagaaaaccggtaaaagggttggtaaggttaagttcgggtaggggttacggtaagttcgttacggaaacg

SEQ ID NO: 361420 - DNA, 542 bp, Homo sapiens
  misc_feature: GZ8MTXP02GE6EN.21.4.A04.1.454.CMB.2.raw
  modified_base (216)..(216): a, c, t, g, unknown or other
  modified_base (267)..(267): a, c, t, g, unknown or other
  modified_base (281)..(281): a, c, t, g, unknown or other
  modified_base (285)..(285): a, c, t, g, unknown or other
  modified_base (294)..(294): a, c, t, g, unknown or other
  modified_base (307)..(307): a, c, t, g, unknown or other
  modified_base (379)..(379): a, c, t, g, unknown or other
  modified_base (384)..(384): a, c, t, g, unknown or other
  modified_base (388)..(388): a, c, t, g, unknown or other
  modified_base (466)..(466): a, c, t, g, unknown or other
  modified_base (480)..(480): a, c, t, g, unknown or other
  modified_base (515)..(515): a, c, t, g, unknown or other
tcagtcgtcgctcgcacgaccggtgctcgatttagagtagtgatcaggggagctctgagagcggagccccagccccagaattcccaggtgttttcatttggtgataagcactgaacacagaggactcaccatggagttgggctgagcttgggttttccttgttgttattttacaaggtgtccagtgtgaggtgcagctggtggagtcgtggggganacgttggtccagccgtggacgggtccctgacgtactctcctgtgcagcctntgcattccaccttnagtnaccacaacntggactcgggccnccaggctaccggaggggaggctgggagtggggtcgccgtatacgaaggaacgctaacagtacagtacagtancggcngtcngtaagaaagtagtcacatacacaagagatagaacttacaaaacgaactcaactgtatactagactaaatagaaacganacgaacgaaaacgngaacgacgcgtagtattatgtagtaagacaaaagngagaagtggcggttgatcgtgtagacg

SEQ ID NO: 361421 - DNA, 571 bp, Homo sapiens
  misc_feature: GZ8MTXP02JXB31.21.4.A04.1.454.CMB.2.raw
  modified_base (356)..(356): a, c, t, g, unknown or other
  modified_base (384)..(384): a, c, t, g, unknown or other
  modified_base (412)..(412): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccgtgggagggtccctgagactctcctgtgcagcctctgcattccaccttcagtgaccacaacatggactgggtccgcaggctccgaggggagggctggagtgggtcgcgtatacgaaggaagctaanagttacagtacagaatacggcgcgtcgngtaggaaaggtaggttcaaccagtcctnaaagagtatagaattacaaaagtactcaacttgtatctgactaaaagtcgaaacacgacctaaggaaaacccgaggaaccgaccggtcgtagttattagttaggacggtaagaaacaaaaggagtaagggtaatcggtagggtggtaacgcgtagtacg

SEQ ID NO: 361422 - DNA, 691 bp, Homo sapiens
  misc_feature: GZ8MTXP02HK2QK.21.4.A04.1.454.CMB.2.raw
  modified_base (202)..(202): a, c, t, g, unknown or other
  modified_base (318)..(318): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanacgcccaccctctcctgcagcctccagccaagaatactccaagagctaactacatacgcctaggtacccagacaagaacgccgtcggcccgaggccctcccgtacggttcccctanacttcttagtcgtccgtcggggtaccccacggacggcccacgtcggccaactccccgaaggtactacgggttaccaggtcggaccgtagggttcggggtactgggggaacctacgggtacctttaccgaccttctactactactaattacgacaacggtacgtacggacgtaccgtagtaaacgtatttaccgagtacgtttagttaactttacgttcgtacgacgtacgtagttacgtacgggtaaacttccgtaaccttacggtcgttcccggtacggtaccggtaaacgggaaaccgtaaaggtaaacgtaaagtaaacggaaacgtacggtaaggtacggtacgacggtacctaactacgttacgttcg

SEQ ID NO: 361423 - DNA, 596 bp, Homo sapiens
  misc_feature: GZ8MTXP02FN8JL.21.4.A04.1.454.CMB.2.raw
  modified_base (305)..(305): a, c, t, g, unknown or other
  modified_base (362)..(362): a, c, t, g, unknown or other
  modified_base (392)..(392): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtgaaccacaacatggactggggtccnccgaggcctccgaggggaaggggctgggaggtgggtcggccgtattacgaaggaaanctaaacagttacagtaacagaatacgggcncgtctaggtacgaaaagggtaaggttcaaccctatactacgaaagagaagtcgtaattaacgaaaaagtacctacaacttagtatctagaacaaatacgaaacacgacctaaggaaaaccggaggacgacggtcgtagtattagtggtagtaacgaaacgtaaaggagtaaggaagttgggtaggtacggtagtacgtgtaacg

SEQ ID NO: 361424 - DNA, 531 bp, Homo sapiens
  misc_feature: GZ8MTXP02INBBS.21.4.A04.1.454.CMB.2.raw
  modified_base (216)..(216): a, c, t, g, unknown or other
  modified_base (276)..(276): a, c, t, g, unknown or other
  modified_base (285)..(285): a, c, t, g, unknown or other
  modified_base (302)..(302): a, c, t, g, unknown or other
  modified_base (346)..(346): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctggggttttccttgttgttattttacaaggtgtccagtgtgaggtgcagctggtggagtctggggganacttggtccagcctgggagggtccctgagactctcctgtgcagcctctgcattcaccttnagtgaccanaacatggactgggtccncaggctcgagggagggctggagtgggtcgccgtatacaaggaanctaacagttacagtacagaatacggcgactctgtagaaaggaggttcaccatctacaaagagatgattacaaagactacactgtaatctgacaaaatgaaacagacctaagaaaccgagacacggcgtagtattagtgtaggtacaaacgaaagtagtggaatggtacggtggtagcgtagtacg

SEQ ID NO: 361425 - DNA, 820 bp, Homo sapiens
  misc_feature: GZ8MTXP02IMGO0.21.4.A04.1.454.CMB.2.raw
  modified_base (311)..(311): a, c, t, g, unknown or other
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcagctgggtggagtcgtgggggagacgttggtccaggcctgggacgggtccctgacgactctcctgtgcagcctctgcattcaccttcagtcgaaccacaacagtggactggggtcccnccgaggcctaccggaaggggaacggggcgtaggggaggtcggggtccggtaccggttaaagttaacgaaaacggggtaaaagtaccgtaaaacgaacggtttaacgaaacggttaaacaaggggtaaaacgttaaccgggggacgtaccggttaccgtagggtttaaacgggaaaaagggggtaacggtttaccaaacccgtaaagtccgttaacgaaaaggtaagtaagttaggtaaactttaaaccgaaaaacggtaaaccgttacctaaacgtttacgggttaaacttccgttaggaaaccctaaaaagttcggaaaaaccgtacgtaaacccgtaaacgggaaaaaacccggcggggaaaaccgaacccgggggttaccgttaacggtttaaagtttaacgtttaggggaacggtttaaaacggaaaaccgtaaaaaagggtcgggtaagggtaaacgttcgggggttacgggtagggtaacggtccgtttaagggggtaacccg

SEQ ID NO: 361426 - DNA, 662 bp, Homo sapiens
  misc_feature: GZ8MTXP02IMGTV.21.4.A04.1.454.CMB.2.raw
  modified_base (437)..(437): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagccctctgcattccaccttcagtcgacccaacaactagtcggaccgtcggggtccccgcccgaggccctacccggaagggggaacggggtccgtggggaggtcggggtccggtccgtaaagttaacgaaaggaaacgactaacgtagttaacaagtacgagaatacggcgtccgtntaggtacggaaaggacgttcaaccctagtccgtagaagtagtagtaggtaataacgaaaacgtaacctctaacgttgtacttactagactaaaagtcgaactacgaccgtaaaggaaaaccgacggaccgacgggtcttagttaagttacgttagggaggttaacgaaaacgaaaaggtggtaaggtacggtgggttacgggtaggttacgtcggttagtaacgg

SEQ ID NO: 361427 - DNA, 716 bp, Homo sapiens
  misc_feature: GZ8MTXP02F27FG.21.4.A04.1.454.CMB.2.raw
  modified_base (202)..(202): a, c, t, g, unknown or other
  modified_base (306)..(306): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaggggaaanacgccaccctctcctgcagcctccagccaagaatactccagagctactacatacgcctaggtaccagcagaacgccgtggccaggcctcccgtaggttccctanacttctacgtcgccgtcggggtaccccaacggacgggcccacgtcgggacctactccccgaagaccgtacggttccgaggtggaccgtagggttcggggtacgtggggaacacggttaccttaccaacttcctacaacttactaattacgacgaaggtacgtagggacgtaccgtaggtaagttacgttcgacgttaaggttacgtttaacgttacgtggtaactaggtaacgtaaggttaagttacgggtaactttacgacccgttacgtttccggttacggttaacccgggaacgggaaaacgggtaaaccgttaaaaaggggtaaaccttaaaaagggtaacggtaaaaccggtaggttaacgggtacggtaacgtaccggaaccttaaccgtattccgtttaaccg

SEQ ID NO: 361428 - DNA, 747 bp, Homo sapiens
  misc_feature: GZ8MTXP02HRFZT.21.4.A04.1.454.CMB.2.raw
  modified_base (202)..(202): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgagggaaanagccaccctctctgcagcctaccagaccaagtaatactaccagacgtactactaacatacgtccgtaggaacccagacaagtaacgccgtggacccacggtccctaccccggtaggtttccctactacttcgtagtcggtaccggtcccgggtaccccacggaaccgggtccctaacggtcggaccaccgtaccccgagtacgtaccggttcgaggtcgacgtaggttcgggtcgtggggaactagtaccttcgactctacagtctaagttacgacgtaacgtacgacggtacgaccgtttaagaacgttacgtttacccggacgtaacgggtttagtttaactttaccgtaggtacctaacggtacgttaaaggttagttacggttaacgttaccctaacccgtttgttaccggttaccgggttacccgggaaaaccggtaaacggggtaaaacccgttaaagggtaaaacgtaaaacggtaacgtaaaaaccggttagtcgggtagtacgttacggaacctaaccggtattcccggtttaacg

SEQ ID NO: 361429 - DNA, 583 bp, Homo sapiens
  misc_feature: GZ8MTXP02ISA6Z.21.4.A04.1.454.CMB.2.raw
  modified_base (285)..(285): a, c, t, g, unknown or other
  modified_base (302)..(302): a, c, t, g, unknown or other
  modified_base (324)..(324): a, c, t, g, unknown or other
  modified_base (347)..(347): a, c, t, g, unknown or other
  modified_base (447)..(447): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtctgggggagacttggtccagccgtgggagggtccctgagactctcctgtgcagcctctgcattcaccttcagtgaccanaacatggactgggtccncaggctcgaggggagggctggngtgggtcgcgtatacgaaggaanctaacagttacagtacagaagtacggcgtcgtctaggtaggaaaacggagggttccaaccgtatcctacaaagtagataggtaattaacaaaagacctanaacttgtatctagtacaaaagtcgaaacagacctaaggaaaaccgaggtacacgggtcgtagttaagttagttggtaggtacgaaaactaaagtagggtaaggtaactgggttaggtcgggtaagtcgtaggtacg

SEQ ID NO: 361430 - DNA, 678 bp, Homo sapiens
  misc_feature: GZ8MTXP02GVQZ3.21.4.A04.1.454.CMB.2.raw
  modified_base (582)..(582): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggccgtgggacgggtccctggagacctctcctgtgcagcctctgctacttcaccttcagtcgaccacaacagtcggactcggggtcccgccgaggcctaccggaagggggaacggggcgtggggacggttcgggggtccggtacccgttaattaaccgaaaggggtaaacgactaaacgacgtttaacgagttaacgagtaaacgtacgggcgtcgttactagggaggaaaaggtacggttaccaaacccgattacgtacgaaagagtataggtaacttacgaaaacgtactacgaacttaggtactacgtagaacaaatacggaaacctagacccgtaaaggaaaaacccggngggaaccgaacgggtccgttagttaatttacggtacgtagggtaaacgaacgaaaagggtagtggaaagtggtagggtgtaaccgtcgtaggtacg

SEQ ID NO: 361431 - DNA, 666 bp, Homo sapiens
  misc_feature: GZ8MTXP02JH2LS.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggagggtccctgagactctcctgtgcagcctctgacattcctaccttcagtcgacccaacaaacagtggacctggggtcccgccgacggcctccggaaggggaacggggcgtgggaggtcggggtccggaccgtaagttaacgaaagggtaaacgcgtaaactagttacaaggttaaccagggaaacgtacggggccgccggttacgtaggttaaggaaaaggggtaacgggttccaaacccgaagtcctaacgaaagagactagtaattaacgaaaagaccttacgaacttagtactctaggaactaaaagtgaaacacgacctaaacggaaaaccggagaaccaccgggtcgttaggtaattacggtagtacgggtaaagaaacgaaaagtgggtaaggaattggggtaggtacgtaggtcgtagtaacg

SEQ ID NO: 361432 - DNA, 639 bp, Homo sapiens
  misc_feature: GZ8MTXP02IBE8C.21.4.A04.1.454.CMB.2.raw
  modified_base (274)..(274): a, c, t, g, unknown or other
  modified_base (325)..(325): a, c, t, g, unknown or other
  modified_base (539)..(539): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagtacgttgggtccaggtccgtgggacgggtccctggagtactctcctgtgcagcctntgcacttcacccttcagtcgaccaacaaaccagtggaccttcggggtcccnccgagggcctccggaagggggaacggggtctggggaggtcggggtaccggccgtaatacgaaggaaacgctaacaggttacagtaacagaacgtacggcgtcgtcgtggtagaaaaggacgttacacctatctacaagagatagacttaacgaaagactacgacttagtaatccgtagactaaatcgaaaacacgaccgtaacggaaaacccgnggaaaccgaaccggtccgtaagttattaacgttaggtaacggttaaagaaacgtaaaaggtaggtaaggtattgggtaggtaggtacgtacgtagtacgg

SEQ ID NO: 361433 - DNA, 562 bp, Homo sapiens
  misc_feature: GZ8MTXP02I56O6.21.4.A04.1.454.CMB.2.raw
  modified_base (287)..(287): a, c, t, g, unknown or other
  modified_base (353)..(353): a, c, t, g, unknown or other
  modified_base (370)..(370): a, c, t, g, unknown or other
  modified_base (384)..(384): a, c, t, g, unknown or other
  modified_base (409)..(409): a, c, t, g, unknown or other
  modified_base (415)..(415): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtcgaccanaacatggactggggtcccgcaggcctccgaggggaagggctggagtgggtcgcgtatacaaggaanctaacagttacagtacngaatacggcgcgtntagagaaaggtagttcaacatctanaaaganatgattacaaaagactcaacttgtaactcgtagacaaaagtcgaaactacgacccgtaaagaaaacccggagaccgacggaccgtgtaattagtgtaggaataaacgaaaagtagtaaggattaggtggtaggtacgcgtagtaccg

SEQ ID NO: 361434 - DNA, 625 bp, Homo sapiens
  misc_feature: GZ8MTXP02GU6CB.21.4.A04.1.454.CMB.2.raw
  modified_base (306)..(306): a, c, t, g, unknown or other
  modified_base (358)..(358): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgctattcaccttcagtcgaccacaacatggactgggtcccnccaggcctccgaggggagggctggaggtgggcggccgtaatacgaaaggaanctaaacagttacagtaacagaatacgggcgcgtcgtagtagaaaagggtagttccaaccatcagaaagagatgaattacaaaagactcacttagtatcgtagactaaaatacgaaaccacggaccctaaaacggaaaaacccggagggaaaccgaacccgggtaccgttaaggtttaaatttacgttacgggtagggttaaaacgaaaacgtaaaaaggtggtaagggtaacttggggtaggggtacggtaagtcgttaggtaaccg

SEQ ID NO: 361435 - DNA, 785 bp, Homo sapiens
  misc_feature: GZ8MTXP02IANRW.21.4.A04.1.454.CMB.2.raw
  modified_base (330)..(330): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttcttgttgttatttacaaggtgtcagtgtgaggtgcagcgtggtggagtcgtggggggagtaccgttgggtcccaggccgttgggacggggtccctggagtactcttcctgtgcagcctctgctattccaccttcagtcgaacccacaaactagtgggaccgttcggggtccccnccgaacggtccgtaccggaagggggaacggggtcgttggggaagggttcggggtacccgggtacccgttaaagttaaaccgaaaggggaaaacgtaccgtaaaaccgtaagtttaacgaacggttaacaggtaaacgttaccggggccgtcggttacgtaggtaaaggaaaacgggggtacgttaccaacccttaagtcccaaggaaaagtagtaaagtagttaaacttaaaccgaaaagtaccttacctaaaggtttcgtaaactttcgtaacggaaactaaaagttccggaaaactaccgtaccggtaaaacggaaaacccgggaggtaaacccgaaccggggtaccttagtttaaagtttaacgtttagggaaggttaaacccgaaaacgttaaaaggacggttaaggtaaagttgggttaccggggtttaggaaccggttcttacgggacg

SEQ ID NO: 361436 - DNA, 703 bp, Homo sapiens
  misc_feature: GZ8MTXP02GBOKK.21.4.A04.1.454.CMB.2.raw
  modified_base (316)..(316): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagtacgttggtccagccgtgggacggtccctgagctctcctgtcgcagcctctgctacttccaccttcagtcgaacccacaacagtggactcggggtcccnccgaggcctaccggaggggaacgggcgtgggaggtcggggtcggcgtaaagttacgaaacggaaagactaaagtagttaacaagtacagtaacgtacggcgtaccgtacgtaggtaggaaaaggtaacggttaccaacccgtagtacctaacgaaaggtaagtacgttaggtaaactttaacgaaaaacgtaaccttaccgtaaccgttaggttaacttaccgttaggaacttaaaaagttaccgaaaacgacgtaaccgtaaacggaaaaccggaacgggaaccgtacgggtaccgttagtttaagttacgttaggtaggttaaacgaaaacgtaaaaggtagtaaggtaagttagggttacggtaggtaacgtcgttacggtacg

SEQ ID NO: 361437 - DNA, 631 bp, Homo sapiens
  misc_feature: GZ8MTXP02FOP3A.21.4.A04.1.454.CMB.2.raw
  modified_base (203)..(203): a, c, t, g, unknown or other
  modified_base (243)..(243): a, c, t, g, unknown or other
  modified_base (298)..(298): a, c, t, g, unknown or other
  modified_base (394)..(394): a, c, t, g, unknown or other
  modified_base (408)..(408): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagngccaccctctcctgcagctccagccaagaatatccagacnctactacatagcctaggtaccagcagaacgcctggaccaggcctccgaggttccncatctatgcgtcgggtcccacgacggccacgtcggcactcccagacacggttcagtcggcgtaggtcgggtcgtggggacagtaccttcgacttcnctatctaattacgngaagtacgtaggacgccgtaagtaacgttacgtttacgcgtaggtttacgttaacgtttacgtgtaccgtagtacgtaaggttacgtagggtaactttacctaccgtttcgttcggttaccggttaccgggaaccggtaaacgggaaccggtaaaggtaaacgtaaagtaacggtaaaaccgtagtcggtacggacgttacgacctaccgtagttacccgttg

SEQ ID NO: 361438 - DNA, 654 bp, Homo sapiens
  misc_feature: GZ8MTXP02J16P0.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgacgactctcctgtgcagcctctgcattccaccttcagtcgaccacaacagtggacgtcggggtcccgccgaggcctaccggaagggggaacggggtcgtggggacggttcggggtaccggaccgttaagttaacgaaagggaaacgtctaaacgacgttacaagttacagaactacgggctcgtcaggtaggaaaggtacgttccaaccatcacaagagatagtaatacgaaagtacctacactagtactcgtagaacctaaagtacgaaaccgtacgaacccgtaaacggaaaacccggagggaaacccgtaacgggtacccgttagttaacttacgttaggtaggtaacgaaaacgtaaaaggtggtaaggtaagttcgggtaggtacggtacgtcgtagtaaccgg

SEQ ID NO: 361439 - DNA, 712 bp, Homo sapiens
  misc_feature: GZ8MTXP02I4LGB.21.4.A04.1.454.CMB.2.raw
  modified_base (282)..(282): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagacctctcctgtgcagcctctgctattccaccttnacgtcgaaccacaacagtggacctggggtcccgcgacggcctccggaaggggaacggggccgtaggggacggttcggggtaccggtaccgttaagttaaccgaaaagggaaacgtcctaaaacgtagtttaaccaacgttaaccgaggtaaacgtaccgggggcgtaccggttacgtagggtaaaggaaaacgggtaacggtttccaaacccgtaatccgtaaacgaaaggtagattaggaatttaaacgaaaagtaaccttacaagttgttaactcgtaggaacctaaaatacgaacacgtacccgaaaacgggtaaccgaaggaaccgacggtactttggtaaatttacggtagggtaaacgtaagaaaaccaaaggggtacgtaagggtaacggtttggacggggttaggtagaccgttagggtaac

SEQ ID NO: 361440 - DNA, 684 bp, Homo sapiens
  misc_feature: GZ8MTXP02I6J0X.21.4.A04.1.454.CMB.2.raw
  modified_base (304)..(304): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtcgaccacaacatggactggggtccncgaggctccgaggggaagggcgtgggaggtggggtccggtccgtaagttaacgaaaggtaaacgcctaaacgagttacaagtaacaggtaaactacgggcgacgtctaggtacgaaaagggtagttccaaacctatcgtacaaagggatagtagtaattaccgaaaaagtaccctagaccttagtaacttctaggaaaccaaaaagttcggaaaactacgggtaaccgttaaacggaaaaaacccggtggaaaacccgtacggggtacccgtttagtttaaagtttaaacgtttaggtaagggtaaacgtaaaaaccgtaaaaaggtggttaaggggctttaagggggtcgggttacggtaggtaccgttaggtaaaccg

SEQ ID NO: 361441 - DNA, 823 bp, Homo sapiens
  misc_feature: GZ8MTXP02HFD8L.21.4.A04.1.454.CMB.2.raw
  modified_base (667)..(667): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagcgtggtggagtcggtgggggagtacgttggtccaggccgtgggacgggtccctgacgtacctctccgtgtcgcacgccctctgctacttccaccttcacgtacgaacccaacaacagtcggacgtcggggtccccacgacggccgtaccggaagggggacggggcgtagggagggtcggggtaccggtaccgttaagtaacggaaacggaaacgtacgtaaaacgacgtttaacgaacgttaacaggtaaacgtaccggcgtacgttacgtaggtaaagggaaaacgggtacggttccaaacccttagtaccgtaacgaaaaggtacgtaagtacggtaaacttaaaaccgaaaaaacgttaccccttaacgtaacgtttacggtaaactttccgaacggtaaaaccttaaaaaagtccggaaaaaccgttacccgggaaacccgtaaaacggggaaaaaaccccgggngggtaaacccggtaaaccccggggtttacgtttaagtttaaaggtttttacggtaaaggggtaacgggttaaaaacgaaaaacggtaaagggttacggggtaaggttaaggtttaccggggttggggttaaggttacgtacggttacggtaaccgg

SEQ ID NO: 361442 - DNA, 682 bp, Homo sapiens
  misc_feature: GZ8MTXP02FT41J.21.4.A04.1.454.CMB.2.raw
  modified_base (265)..(265): a, c, t, g, unknown or other
  modified_base (307)..(307): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccaggcctgggacgggtccctgagactctcctgtgcagcctngcattccaccttcagtcaccacaacatggactcggggtcccnccgaggcctccggaggggaacggggctaggggaggttcggggtccggacgtaattaacgaaaggaaacgtctaaacgtacgttaacgagttaacaggaaactacggggcgtccgtagtaggtaaggaaaagggtaagttccaaacccgattacctacgaaaggagagttacgtaaattacgaaaaacgtaccttacgtaacttaggtaaacttccgttagaaaccttaaaagtaccggaaaactacggaccgtaaacggaaaacccggaggtaaccgaacgggtaccgttagttaactttaggttagtaacggtaacgaaaacgaaaaggtaggtaaggtaagtagggtagggtacggtaaggcgtttaggaacg

SEQ ID NO: 361443 - DNA, 647 bp, Homo sapiens
  misc_feature: GZ8MTXP02ITRC4.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggagggtccctgagactctcctgtgcagcctctgcattcaccttcagtgaccacaacagtggactcggggtcccgccaggcctaccgaggggaagggctgggagtgggtcggccgtataacgaaggaaagctaaacgagttacagtaacaggtaatacggcgcgtctggagaaaagggagttccaaccgtatccgtagaaagagattaggaacttaacgaaaagtaacctcgtaacttggtaaattccgtagaaccaaaaagttccgaaaactacggaaccctaaacgggaaaaaccggacgggaaccgaaacccggggttccgttaagtttaagtttaacgttagggtaagtaaacgaaaacgtaaaaggtggtaacggtaagtgggtttacgggagttagcgtttagaacg

SEQ ID NO: 361444 - DNA, 848 bp, Homo sapiens
  misc_feature: GZ8MTXP02JAPW6.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagccgtgggacgggtccctggacgactcctcctggtgcagcctctgcattccaccttcagtcgaaccccacaacagtcgggacgtcggggtcccgccgacggccgtacccggaagggggaaggggcctaggggaggttcgggggtaccggtccggttaaattaaaccggaaaagggtaaaacgaccgttaaaaacgtacgtttaacgaaacggtaacagggtaaacgtaccggggacgtccggtttacgtacggggttaaagggaaaacgggggtaaacggtttaccgaaacccgtaacttaccgttaacgaaaaggtaaagtaagttaacggttaaacgtttaaaccgaaaaacgtaaaccttaaacccgtaaaccgtttaaggtttaacgtttacgttacgtaaacgtaaaagttaacgaaaaccgtaaccggtaaccgtaaacgggaaaaacccggaaacggggtaaaacccggaacccgggttaccggttaacggtttaaacgtttacggtttaaaggttaacgggtcggtaaaaaaaaaaaaaacgtaggtaaaaggggttaagggtaaggttaggggttaggggttacgggttaggtacgtttacggtaaaccgg

SEQ ID NO: 361445 - DNA, 640 bp, Homo sapiens
  misc_feature: GZ8MTXP02J004F.21.4.A04.1.454.CMB.2.raw
  modified_base (312)..(312): a, c, t, g, unknown or other
  modified_base (415)..(415): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgacgactctcctgtgcagcctctgcattcaccttcagtcgaccacaacagtcggactcggggtcccnccgaggcctccggaaggggaacggggctggggaggtcggggtccggaccgtaattaacgaaaggaaagcctaaacgagttaacagtacaggaactacgggcgngtcgtaggtagaaaagggacgttccaccgatacgtaacaagtagatagaacttaacgaaaagtacctacgaacttggtatacgtagacctaaaagtcgaaaccaggaccctaaggaaaacccggaggacgaccggtaccgttattaagttacttgggtaaggtaacgaaaacgaaaagggtagtaagggtaattggggtagggttaggtacgtcgttaggtaccg

SEQ ID NO: 361446 - DNA, 887 bp, Homo sapiens
  misc_feature: GZ8MTXP02HS6N7.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgatctgggttttccttgttgttatttacaaggtgtccagtgtgaggtgcagctggtggagtcgtgggggagacgttggtccagccgtgggacgggtccctggacgacttctccgtgtcgcagcctctgcattccaccttcagtcgacccaacaacagtgggaccgtcggggtcccgccgagggcctaccggaagggggaacggggcgtaggggagggttggggtaccgggtaccggttaaagttaaccgaaaggggtaaaacgaccgttaaaacgtaggtttaacaaacggttaacaggtaaacgttaccggggcgtccggttacgtaggggtaaaggaaaaacgggggtaacggtttaccaaacccgtaagttacccgtaagaaaaggtaacggtaagttaaggtaaactttaaaccgtaaaaaaacgggtaacccttacgaaaccgttttacggtttaaacttaccgtaaagggtaaaacctaaaaacgttaacggaaaaaccctaacgggtaaccccccggttaaaaaggggaaaaaaaacccccggggcggggtaaaaccccggtaaacccgggggttacccggtttaaagggtttttaaaaccgtttaaagggtttaaccggggttaaaggggtttaaaacccggaaaaacggtaaaaaaggtaggggttaaccggggttaaaaggttcgggggtttagggggtaccgggttaacggtaccggtttacgggtaaaccgg

SEQ ID NO: 361447 - DNA, 596 bp, Homo sapiens
  misc_feature: GZ8MTXP02FQWKR.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacttgggtccagcccgtgggacggggtccctgagactctcctgtgcagcctctgcattcaccttcagtgacccaacaacatggactggggtcccgccgaggctccgaggggaaggggctggaggtgggtcggccgtattacgaaggaaagctaaacagttacagtaacagaaagtacggcgcgtctaggtagaaagggtaaggttcaaccctatcctagaaagagatagaattacgaaaacgtactacaacttagtattctagaacaaatagaactagcctaaagaaaacccgagaaccgacggacgtagtatttataggtacgtagaaaacgaaaggtagtaaggtagttaggtagggttcggaagtcgtaggtacg

SEQ ID NO: 361448 - DNA, 845 bp, Homo sapiens
  misc_feature: GZ8MTXP02GSZ4C.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccaggccgtgggacgggtcccctggagactctcctgtgcagcctctgcattcaccttcagtcgaccacaacagtcgggaccgtcggggtcccgccgacggtcctaccggaaggggggaacggggccttagggggtaacggggttcgggggtacccgggtacccggttaaacgtttaaaccggaaaacggggtaaaacggtcccttaaaaacggtaacggtttaacccgaaaaggttaaacccgaagggtaaaacgttacccgggggaccggtaccgggttaccttagggggtaaagggaaaaacggggttaacggtttcccaaaacccgttagttacccgaggaaaaggtagtactaggtaaacttaacgaaaaacgttaaccgtaccaagtttaaggtacttccgtaaaggaacctaaaagtaccgaaaacctacggtaacccgtaaaacggaaaaacccggcgggtaaacccgaccggggttacccgtttaaggttaattttaaacggttcgggggtaaaggttaaaacggaaaaaccgttaaaaggggttaggttaaggggtagttagggggtttaaggggtacccgggttaagtccgtttagggggttaaacccg

SEQ ID NO: 361449 - DNA, 679 bp, Homo sapiens
  misc_feature: GZ8MTXP02G56SN.21.4.A04.1.454.CMB.2.raw
  modified_base (269)..(269): a, c, t, g, unknown or other
  modified_base (293)..(293): a, c, t, g, unknown or other
  modified_base (297)..(297): a, c, t, g, unknown or other
  modified_base (310)..(310): a, c, t, g, unknown or other
  modified_base (668)..(668): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggcccgtgggacgggtcccctgagactctcctgtgcagcctngctacttcaccttcagtcgaccanaacntggactcgggccncgaggcctaccgaggggacgggctggaggtcgggtcggaccgtagttaacgaaaggaaagtcctaaacgtaggttaaccaaggttaaccaggaaaacgttccggggacgtaccggtctagggtaacgggaaaagggtacggtttacccaacccgtaagttcccaagaaagtagtagttacgaaacgtttaacgaaaaacggtacctaaccgtaaactggtttaactaccgttagaactaaaacgtacgaaacgttaacggacctaaacggaaaaccggaggaacaccgggtaccgtaagttagtgttagacgggttaagaaacgaaagtaggtaaggtaagtggtagggtacggttancggttagaacg

SEQ ID NO: 361450 - DNA, 631 bp, Homo sapiens
  misc_feature: GZ8MTXP02GQTU8.21.4.A04.1.454.CMB.2.raw
  modified_base (201)..(201): a, c, t, g, unknown or other
  modified_base (238)..(238): a, c, t, g, unknown or other
  modified_base (292)..(292): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccacctctcctgcagcctcagccagaatatccaganctactacatagctaggtaccagcagaagcctggccaggcctcccgaggttcccncatcctatcgcgtcgggtccccagacgggaccctacgtcggacctacgtccccgaaggtaccgtacgggtttccagggttcgggacctaggggttcggggtcgtcgggggaaactaggtacctttcaaccgttctacactactagttagcaacggacgtaggtacgtccgttagaacgttagtttcgacgtagttgttaatttaccgtgtacgagtctaagttagttaggtacgttcaccttcgtaggttccgtacggaccgtaaaggaaccgtaaaggtaacgtaaaactacggaaaaccgtaacgtggtacggactacggacctacgtactcgttcg

SEQ ID NO: 361451 - DNA, 644 bp, Homo sapiens
  misc_feature: GZ8MTXP02FT4Q8.21.4.A04.1.454.CMB.2.raw
  modified_base (503)..(503): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctctgctattccaccttcagtcgaccacaaccagtggacgtcggggtcccgccgaggccgtccgagggggaacggggcgtggggagggttcggggtccggccgttaaagttacgaaacggaaaagtcctaaaacgagtttaacagtaacagaactacgggcgtcgtcgtaggtagggaaaaggtacggttcaaccgtatctacaaagagatagtaattacaaaagtactacaacttgtaacncttagactaaaagtagaaacgacgaccttaaaacgggaaaaccgagggaaccaacgggtccgtaggttaattaggtttgtaacgggtaagtaaaacaaaaggtaggaaggtaatggggttacggtagtagcgttggtaacg

SEQ ID NO: 361452 - DNA, 679 bp, Homo sapiens
  misc_feature: GZ8MTXP02JTN24.21.4.A04.1.454.CMB.2.raw
  modified_base (203)..(203): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgcccaccctctcctgcagcctccagccaagaaatatacaaagacgacttaactaacatacggccctagggtaacccagacaaggaacgccgtgggcccacgggccctaccccgtaggtttccccagtattccgtatcggcgtccggggtaccccaacggacgggccctacgtcggctaactccccgagtacgacggttcagggttcggcgtagggtggggtctgggggacacggtaccttcgacttccgtactagtacctagttacgacgaacggtacgtagggaacgtcccgtaaggtaacgttacgtttaccggacgttaggttacgtttaacgtttacgtcgtacgagtacgtagttagtgggttaactctacgttgtacggtccgtacggaccggtaaggaaccgaaaggttaacgaaacgttaacggaaacgtacgtggtacggactacggacctactacgtacgttcg

SEQ ID NO: 361453 - DNA, 638 bp, Homo sapiens
  misc_feature: GZ8MTXP02HAHIQ.21.4.A04.1.454.CMB.2.raw
  modified_base (364)..(364): a, c, t, g, unknown or other
  modified_base (391)..(391): a, c, t, g, unknown or other
  modified_base (419)..(419): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtcgaacccacaacagtggacgtggggtccccgccgaggcctccgaggggaaggggctgggagtggggtcgccgtatacgaaggaanctaacagtacagtacagactacggcgngtctgagaaaggtagttcaccgatcganaagagatagaacttacaaaagtactacactagtaactgtagacctaaaagtcgaaacgtacgacccgtaaaggaaaaacccgggaggaaaacccgtaccgggggtacccgttaagtttaaagtttaacgtttagggtaagggttaaagaaaacgaaaaaggtagggttaagggtaaattgggggtacggtttaggggtaaagtaccggtttggaaacgg

SEQ ID NO: 361454 - DNA, 632 bp, Homo sapiens
  misc_feature: GZ8MTXP02GMABT.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggtgagctgggttttccttgttgttatttacaaggtgtccagtgtgaggtgcagctggtggagtcgtgggggagacttggtccagccgtggacgggtccctgagactctcctgtgcagcctctgcattccaaccttcagtcgaacccaacaacatggactgggtcccgccaggctaccggaggggaaggggctggggaggtcggggtccgaccgtaagtaacgaaagggaaacgactaaaccgagttaacacgtaacaagagtacggcgacgttcagtaagaaaaggtacggttacaacgatacgtacaaaggagaatgaataacaaacgaactacaactgtatactagaacaaatacgaaacacgtaccgtaaacgaaaaccggaggaaaccgacggtaccgtagttaaacttaggttacggtagggtaaagaaacgaaaaaggtggtaggtaagttgggtaggttacggtagtcgtaggtacgtaaaccg

SEQ ID NO: 361455 - DNA, 796 bp, Homo sapiens
  misc_feature: GZ8MTXP02IZQR8.21.4.A04.1.454.CMB.2.raw
  modified_base (313)..(313): a, c, t, g, unknown or other
  modified_base (755)..(755): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacgttggtccagccgtgggacgggtccctgagactctcctgtgcagcctctgctattccaccttcagtcgacccacaacagtggacgtcggggtcccnccgaggccctaccggaaggggaacggggcgtaggggacgggttcggggtccgggtacccgtaaagttaaccgaaaacggggtaaaacgtaccgttaaaaccgaagtttaaaccgaaacggttaaaccgaaggggtaaaccgttaaccgggggtccgtaccgggtttaccgttagggggtaaaagggtaaaaaacggggtaaacggggttttacccaaacccgtaagttaccgttaacgaaaagtaacggtaattaagtaaacgttaaaccgaaaaaacggtaacctttaacccaaagtttcggtaaacttaccgttaggaaacctaaaaaagtacgaaaaccgtaacgacccgtaaaacgggaaaacccgacgggaaaacccgtaccggggtaccgttaagtttaagtttagttaggtaaggttaacgaaaacgtaaaaggngtaagggtagtaggttacggggtagtagtcgttaggtaacg

SEQ ID NO: 361456 - DNA, 712 bp, Homo sapiens
  misc_feature: GZ8MTXP02JJBW4.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcgtgggggagacgttggtccgagcctgggagggtccctgagactctcctgtgcagcctctgctattccaccttcagtcgaacccaacaacagtggacgtcggggtcccgcgaggcctccggaggggaacggggcgtaggggtaggttcggggtccggtcccgtaaagttaacgaaaacggggaaacgtacctaaaacgaggtttaacaacggttaaccgaagggtaaacgtaaccggggcgtccgtacgtagggttaagggaaaagggtaacggttccaaacccgtatccgtaacgaaagtagtacgtagtaaactttacgaaaaacgtactaccgtaacgttaggtaacttcgtagaacctaaaagtacgaaaccgacgtaacccgtaaacggaaaacccggtagaacccggaacggtacccggttagttaaacgttagttaggtacggtaagtaaaacgaaaggtaggtggaagtcggtagggtagtacgtacgtacgtacg

SEQ ID NO: 361457 - DNA, 805 bp, Homo sapiens
  misc_feature: GZ8MTXP02G9Y28.21.4.A04.1.454.CMB.2.raw
  modified_base (269)..(269): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggaggtcgtgggggagtacgttggtccagccgtgggacgggtccctgagactctcctgtgcagcctcngctacttcaccttcgagtcgacccaacaacagtcgggacgtcggggtccccgcccgaggccctaccggaagggggaacgggggccgtaggggaggttcgggggtaccggtaccggttaagttaacgaaaacggggtaaaacgtaccttaaaacgtaacggtttaaccgaagttaaccgaggtaaacgttaaccggggccgtaccggttctaggggtaaacgggaaaaggggtaaccgggtttaccaaacccgtaagttaccgtaaccgtaaaagggaacgtaagtagttaaactttaaaccgaaaaaacggtaaccttaacctaacgtttacggttaacttccgttaaggaactaaaaacgttacggaaaaccgaacggtaacccgtaaaacgggaaaaacccgggtaggggaaaccctaccgggggtacctttaggtttaaagtttaacggtttgggtaaacggggttaaggaaaaccgtaaaggggtagtaaggtaacgttggggtaggggtaggtaaccgtcgttaggtaacg

SEQ ID NO: 361458 - DNA, 671 bp, Homo sapiens
  misc_feature: GZ8MTXP02F5JQ3.21.4.A04.1.454.CMB.2.raw
  modified_base (193)..(193): a, c, t, g, unknown or other
  modified_base (304)..(304): a, c, t, g, unknown or other
  modified_base (325)..(325): a, c, t, g, unknown or other
  modified_base (378)..(378): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtncagctgggtggagtcgtgggggagacgttggtcccaggcccgtgggacgggtcccctggacgaccttcctcctgtcgcagcctctgctattcaccttcagtcgaacccaanaacagtggactcggggtcccncgaggcctccggaaggggagggctgggaggtcgggcgctaatacgaaaggaanctaaacagttacagtacaggaaactcgggcgcgttcgtagggtaacggaaaagggtaacgggttccaaaccctaagtacccgtaacgaaaagtaggtacgttaagtaaacttaaaccgaaaaaagttacctaccgttaaacgttggttaaacttccgtagaaaccgtaaaataccgaaaacgacgtaaccgtaaacgggaaaaacccggaggtaaccgaacggtacgttagtaatttagtaggtagtaaagaaactaaaggagtggactaggtcgggtagtacgcgtagtacg

SEQ ID NO: 361459 - DNA, 621 bp, Homo sapiens
  misc_feature: GZ8MTXP02HMMCV.21.4.A04.1.454.CMB.2.raw
  modified_base (200)..(200): a, c, t, g, unknown or other
  modified_base (268)..(268): a, c, t, g, unknown or other
  modified_base (296)..(296): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgctccgagggaangccacctctcctgcagctccagccagaatatccagacgctactacatacgcctggaccagcagtaacnccgtggccaggcctcccgaggtttcccncaactctatggcctggggtccccaagcgggccacgtggcacgtcccaggactacggtcaggtggcaggtggtcgtggggactaggtacctttcacttcgtactactctagttacgctaagtacgtgggtacgccttaaggaaacgttcgtttcgacgttagtagtttacttacgttgaccagtctaaggtacgtagggtaacttccgtaacgttcgttcggttccggttaaccgggaccgtaaagggggtaaacctaaagggttaacgaaaagtacggaaaacgtacgtgggtacggtactacggacctaccgtaagttcgttcg

SEQ ID NO: 361460 - DNA, 571 bp, Homo sapiens
  misc_feature: GZ8MTXP02IEV12.21.4.A04.1.454.CMB.2.raw
  modified_base (278)..(278): a, c, t, g, unknown or other
  modified_base (353)..(353): a, c, t, g, unknown or other
  modified_base (443)..(443): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacttggtccagcctgggagggtcccctgagactctcctgtgcagcctctgcattcaccttnagtgaccacaacatggactgggtcccgccaggcctccgagggagggctggagtgggtcgccgtatacgaaggaanctaacagttacagtacagaactacgggcgtacgtctaggtaggaaagggtaacggttcaccgattcacaagagatgattacaaaagtacnctaactgtatctagacaaaatcgaaacacgcctaaaggaaaccgaggacacgggtccgttattagttagttggaggtaaagaaacaaaggtaggtaaggattgggtacgggtaggtagcgtaggtccg

SEQ ID NO: 361461 - DNA, 624 bp, Homo sapiens
  misc_feature: GZ8MTXP02F9Y24.21.4.A04.1.454.CMB.2.raw
  modified_base (332)..(332): a, c, t, g, unknown or other
  modified_base (389)..(389): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgcattcaccttcagtcgaccacaacatggactgggtcccacgaggctcgaggggaagggctgggngtgggtcgccgtagtacgaaggaaacgctaaacagttaacagtaacagaatacggcncgtctaggtagaaagggtaacgttcaacctatctacaaagagatagaattacaaaagtaacctactaacttaggtaactacgtacggaactaaaagaagaacgaacgtaccgtaaacggaaaaccggaaacggaacgaacggtaccggtacgttaagttaacgttagttacggtaacgtaaacgaaaagtaaaggtaaggtaggtaggtagggtaggtacggtacgtcgtaacgg

SEQ ID NO: 361462 - DNA, 637 bp, Homo sapiens
  misc_feature: GZ8MTXP02JOL1Z.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtcgaccacaacatggactggggtcccgccaggcctccggaaggggacggggctgggaggtgggtccggacgtattacgaaagggaagctaaacagttacagtaacagtaacgtacggcgcgtcgtaggtagaaaagggtaacgttcaaccgtatcgtacgaaagtacgagtagtaattaacgaaaagaaccttacacgttagtactacgtagaactaaaagtacgaaacacggtaacctaaacggaaaaccggacggaaccgacggggtaccgttaggttaatttaagttacggtaaaggttacgaaaacgtaaaaggtgtaaggtagttggtagggttcggtaggtcgtagtaaccg

SEQ ID NO: 361463 - DNA, 774 bp, Homo sapiens
  misc_feature: GZ8MTXP02IA8HZ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagccgtgggagggtccctgagactctcctgtgcagcctctgcacttccaccttcagtcgacccaacaaaccagtgggaccttcgggggtccccgacccgaagggtcctaccggaagggggaaacgggggcgtaggggaggttcgggggtccgggtaccgttaagttaaccgaaaaggggaaaacgtaccttaaaacgaaggtttaaccaaaggttaaccgaagtaaaacgttaccgggaccggtcgttacgtagggtaaaggaaaaggggaaacgggtttaccaaacctacgtaccgttaacgaaagtaggtaagttaggtaaactttaaaccgaaaacggtaaacctaaacctaccgttaggttaacttaccgttaaggaacctaaaatacgggaaaacctacggaacccgtaaacggaaaaacccggaacgggaaccggaaccgggtacccggttaggtttagttagtttagggtaacggttaaagaaacgtaaaaaggtggtaaagggtataggggttaggtacgggtaagtcgttaggtaacg

SEQ ID NO: 361464 - DNA, 775 bp, Homo sapiens
  misc_feature: GZ8MTXP02J0YSC.21.4.A04.1.454.CMB.2.raw
  modified_base (323)..(323): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggccgtgggacgggtccctgacgactctcctgtgcagcctctgctacttccaccttcacgtcgaaccaacaacagtcgggactcggggtaccccnccgagggcctaccggaagggggaacggggcgtaggggagggttgggggtacccggaccggttaaagttaaccgaaaaggggaaagtacctaaaacgtagttaacaagttaacgaggtaaacgtacgggcgtacgtcgtagggtaaacggaaaagggtaacggttaccaacccgtaagttaccctaacgaaaaggagtaacgttaaggtaaactttaaaccgaaaaacgtaaaccttaccgtaaccgttaggttaacttacgttacggaaactaaaagtacggaaaaccgaaacggaacccgttaaaacgggaaaaacccgggacggtaaaccgaacccggggttaccgttaaggttaactttaacggttacgggtacgggttaaagaaaaccgtaaaaggtaggtaagggtagttagggttacggggtaggtacggtacggttggtaaccgg

SEQ ID NO: 361465 - DNA, 670 bp, Homo sapiens
  misc_feature: GZ8MTXP02JXD2Y.21.4.A04.1.454.CMB.2.raw
  modified_base (306)..(306): a, c, t, g, unknown or other
  modified_base (574)..(574): a, c, t, g, unknown or other
  modified_base (630)..(630): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtccctgagactctcctgtgcagcctctgcattcaccttcagtcgaccacaacatggactggggtccncgaggcctccgaggggaaggggcgtggggaggttggggtccggaccgtaagttacgaaacgggaagctaaacgagttacaaggttaacagtaaacgtaacgggccgtacgtcgttaggtaaggaaaacggggtacgggtttaccaaaccccgtagttaccgtaaccgaaaagggtaagtagtaggtaaactttacgaaaaacgtaacctacgaccttagtacttcgaggactaaaagtcggaaaccaggtaccctaggaaaaacccgnggaaccacgggtaccgttagtaagttagttacgggtacggtaagaacgtaaaaggnggtaaggaacgttgggtaggtacggtagcggttacgacgg

SEQ ID NO: 361466 - DNA, 785 bp, Homo sapiens
  misc_feature: GZ8MTXP02IJH85.21.4.A04.1.454.CMB.2.raw
  modified_base (297)..(297): a, c, t, g, unknown or other
  modified_base (309)..(309): a, c, t, g, unknown or other
  modified_base (332)..(332): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggttttccttgttgttatttacaaggtgtccagtgtgaggtgcagcgtgggtggagtcgtgggggagtacgttggtcccaggtcccgtgggacgggtccctggacgtacctctcctggtcgccacgtcctctgctacttcaccttnagtcgaccccanaacagtggacgtcggggtacccnccgaggcctccggaaggggacgggtctaggggtacggtcggggtccggtaccgtaaattaacgaaacgggtaaaacgtcctaaaacgtacgttacaaggttaaccagggtaaacgtacggggaccggtaccgttacgtaggggtaacggaaaaacggggttacggttccaaacccgtataccgttaaacgaaaaggtaagtagtaaacggtaactttaaacgaaaaacgtacttaccgtaaacccgtttaggtaacttacccgttaggtaaacctaaaagtaccgtaaaaccgtacggttacccggaaaacggaaaaccccgggtaggaaccccgtaaccgggggtaccgtttaggtttaaaatttcgggtttaaaggacggttaacgtaaaaacgtaagaggggttaacgtaaggttcggggttagttaagggtcgtacgttacggtaaccg

SEQ ID NO: 361467 - DNA, 649 bp, Homo sapiens
  misc_feature: GZ8MTXP02IN9FK.21.4.A04.1.454.CMB.2.raw
  modified_base (266)..(266): a, c, t, g, unknown or other
  modified_base (311)..(311): a, c, t, g, unknown or other
  modified_base (376)..(376): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcgtgggggagacttggtccagccgtgggagggtccctgagactctcctgtgcagcctntgctattcaccttcagtcgacccacaacagtggacgtgggtcccncgacggcctcggaaggggagggctgggaggtcgggtaccggtaccgtaagtacgaaagggaaacncctaaacgtagttacaagttaacaggtaactaccgggcgtcctcgtaggtaagggaaaaggtaacggtacaaccgtatacctaacgaaagagatacgtattaaacaaaacgactacacttagtaactcgtagaacctaaagtacgaaacgacgaccgtaaacggaaaaccgaggaccgtaacgggtaccgttagttaactttagttaggtaaggtaaacgaaaaccgtaaaaggtagtaaggtagttacggtgggtaggtacgtcgtagtacg

SEQ ID NO: 361468 - DNA, 608 bp, Homo sapiens
  misc_feature: GZ8MTXP02G0C20.21.4.A04.1.454.CMB.2.raw
  modified_base (363)..(363): a, c, t, g, unknown or other
  modified_base (383)..(383): a, c, t, g, unknown or other
  modified_base (458)..(458): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggccgtgggagggtccctgagactctcctgtgcagcctctgctattcaccttcagtgaccacaacagtggactggggtcccgcaggctcgaggggagggctggagtgggcgcgtatagaacggaagctaacagtanagtaacgagaactacgggcncgtctagagaaagggagttcaaccatctacgaaagagagtagtaatacaaaagtactacactgtatcacgtaaanaaacgtacgaaacgacgtaaccgaaacggaaaaccggacggaaccggtacggtacgttagttaagtttacggtaggttaacggtaaaacgaaacggtaaaggtaggtaaggtaggttaggggttacgggtaggtacgcggttaggtaacg

SEQ ID NO: 361469 - DNA, 744 bp, Homo sapiens
  misc_feature: GZ8MTXP02G2K52.21.4.A04.1.454.CMB.2.raw
  modified_base (218)..(218): a, c, t, g, unknown or other
  modified_base (305)..(305): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttagttattttacaaggtgtccagtgtgaggtgcagctggtggagtcgtggggganacttggtccagcctggagggtccctgagactctcctgtgcagcctctgcattcaccttcagtcgaccacaacatggactggggtccnctaggcctaccgaggggaagggctgggacggtgggtcggaccgtaagttaacgaacgggaaagctaaacgagtttaaccgagttaacgaggtaaactacggggcgacgttctaggtaaggaaaagggtaggttccaaaccctagttccctaacgaaagaaggtatagtaacgttaacaaaaacggtaccttaacgaaccgtttaggtaaacctttccgggtaaacgaaactaaaagtaccggaaaaccgtaccggtaaacccgtaaaacggggaaaaacccggtacgggaaacccggttaacccgggggttacggtttaaaggtttaacgttttaacgggttagggtaaaacgggtaaaacgtaaaaacggtaaaaggggttaggtaagggtaaaggttcggggttaggggtaccggttacggtacgtttaggtaaccg

SEQ ID NO: 361470 - DNA, 556 bp, Homo sapiens
  misc_feature: GZ8MTXP02G85CE.21.4.A04.1.454.CMB.2.raw
  modified_base (216)..(216): a, c, t, g, unknown or other
  modified_base (263)..(263): a, c, t, g, unknown or other
  modified_base (276)..(276): a, c, t, g, unknown or other
  modified_base (302)..(302): a, c, t, g, unknown or other
  modified_base (352)..(352): a, c, t, g, unknown or other
tcagtcgtcgctcgcacgaccggtgctcgatttagagtagtgatcaggggagctctgggagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtggggganacttggtccagcctgggagggtccctgagactctcctgtgcagcctntgcattcaccttnagtgaccacaacatggactgggtccncaggctccgagggagggctgggagtgggcgcgtatacgaagaacgctaanagttacagtacagatacgggcgacgtctagtagaaagggtagttacacatcacgaagagatagaattacaaagactcaatcgtaatctagactaaagtacgaaacacgacctaacgaaaaccgaggaacgacggccgtagttagttattggtagtaacgaacgaaaaggtgtaggaagtggtacggtaggtagcgtgacgtacg

SEQ ID NO: 361471 - DNA, 769 bp, Homo sapiens
  misc_feature: GZ8MTXP02FTJFU.21.4.A04.1.454.CMB.2.raw
  modified_base (214)..(214): a, c, t, g, unknown or other
  modified_base (261)..(261): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttatttacaaggtgtccagtgtgaggtgcagctggtggagtcgtggggganacttggtccagccgtggacggtccctgagactctcctgtgcagcctntgctattccaccttcagtcgaccacaacatcggacgtcggggtcccgccgaggtcctaccggagggggaacggggcgtggggaggttcgggggtccggaccgttaagttaacgaaacggggaaagtacctaaaacgacgtttaaccaagttaacgaggtaaacgtacggggaccgtccgttactaggggtaagggtaaaacgggtaacgggtttacccaaacccgtaagtaccgttaaccgaaaaggagaacttaggaaactttacgaaaaagtacctacgtaaaccgttagtttaactacgttacggaaactaaagtacgaaaaccgtacggaacccgttaaaacggaaaaccccggaacgggaccgtaaacccggggtccggtttacggttaaagttttaacggtttacgggttaacgggtaaaggtaaaaaccgtaaaagggtaagggttaaggggtatttacgggggtagggggttaggttacggacggtttacggtaaacggg

SEQ ID NO: 361472 - DNA, 512 bp, Homo sapiens
  misc_feature: GZ8MTXP02G1IFP.21.4.A04.1.454.CMB.2.raw
  modified_base (196)..(196): a, c, t, g, unknown or other
  modified_base (205)..(205): a, c, t, g, unknown or other
  modified_base (262)..(262): a, c, t, g, unknown or other
  modified_base (284)..(284): a, c, t, g, unknown or other
  modified_base (385)..(385): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccagggaangccaccctntcctgcagctccagccagaatatccagagctactacatacgcctggtaccagcagancctggccaggctccaggttccnatctatgctcggtcccagcggccagtggcatcccagacacgggttcagtggcaggtgggtctggggaccagaccttcactctcatcattagcagctggacnccgtagaagtatttcgactagtgtattactgtcagcagtataggtaattcactgtgtcgttcggacgtaaggaccaaggtaacgaaagtacgaaaccgtaagtggtacggactcgacacctatctcg

SEQ ID NO: 361473 - DNA, 658 bp, Homo sapiens
  misc_feature: GZ8MTXP02H8MN9.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagcctgggagggtccctgagactctcctgtgcagcctctgcacttcaccttcagtcgaccacaacagtggactcggggtccgaccacggctccgaaggggaggggctgggagtggggtcgaccgtattacgaaggaagactaaacagttacagttaacagaaacgtacggcgtcgtcgtaggaaggaaacggtacggttacacgtatcgtacaaagtagatagtaactaacaaaagtaactacaacgtttgtaacttcgacggaactaaaagttacgaaaaccacgggtaacccaaaacgggaaaaacccgacgggaaaccgtaacccgggtacgttaaggtttaactttagttagggtaacggtaaaacgaaacgtaaaaaggtggtaaggtaggttaggttaggggtacggtagtacggtttagaccgg

SEQ ID NO: 361474 - DNA, 805 bp, Homo sapiens
  misc_feature: GZ8MTXP02JOW1Y.21.4.A04.1.454.CMB.2.raw
  modified_base (272)..(272): a, c, t, g, unknown or other
  modified_base (287)..(287): a, c, t, g, unknown or other
  modified_base (317)..(317): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctggagctgggttttccttgttgtttattttacaaggtgtccagtgtggaggtgcagctgggtggagtcgtgggggagtacgttgggtccagccgtgggagggtccctgagactcgtcctgtgcagcctntagcattcgaccttnagtcgaccagaacatcggactgggtacccnccgaaggcctccggaaggggaacgggctgggaggtcggggtcggtacccgtaataccgaaaggggaaactctaaacgtaaggttacgaacgtaacgagtaaacgttacgggcgtaccgttactagggtaaagggaaagggtaaagtttcccaaacccgtattacccgtacaaaagggtaagagttacccggtaaatttaaaacgaaaaaccgggtaaaccttaccgtaaaccggtttagttaaactcccggttaaacgaaaccgtaaaaagtaaacgtaaaccgaaccgtaaacccgtaaaaccggaaaaccggaaaccgggaaaccggtaaacccgggtaaccggttaacggtttaaacgtttaaacggtttaacgggttaaacgggttaaaacggtaaaacggtaaaaacgggtaaaacgggttaagggtaacgggttaacggggttacggggttaacgggttaacgggtacggttacggtaacgg

SEQ ID NO: 361475 - DNA, 629 bp, Homo sapiens
  misc_feature: GZ8MTXP02IYDCU.21.4.A04.1.454.CMB.2.raw
  modified_base (217)..(217): a, c, t, g, unknown or other
  modified_base (304)..(304): a, c, t, g, unknown or other
  modified_base (349)..(349): a, c, t, g, unknown or other
  modified_base (376)..(376): a, c, t, g, unknown or other
  modified_base (381)..(381): a, c, t, g, unknown or other
  modified_base (399)..(399): a, c, t, g, unknown or other
  modified_base (404)..(404): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccagcctgggagggtccctgagactctctgtgcagcctctgcattcaccttcagtgaccacaacagtggactggggtccncaggctcgagggagggctggagtgggtcgccgtatacgaaggaanctaacagttacagtacagaatacggcncgtcngagaaagagtcacatcanaagantagattacaaaagtctacactgtaacttctacgactaaaatcggaaacacggtaccgtaaaacggaaaaccggaggggaaaccctaaccgggggtaccttaggtttaaaactttcgggtttaacgggtaggttaaaacggaaaaaccgtaaaaaggggttaggtaaggggtaaactttgggggttaacggggttacgggtaaacggtccgtttagggtaaaccgg

SEQ ID NO: 361476 - DNA, 603 bp, Homo sapiens
  misc_feature: GZ8MTXP02FS8I3.21.4.A04.1.454.CMB.2.raw
  modified_base (408)..(408): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagccgtgggagggtccctgagactctcctgtgcagcctctgctattcaccttcagtcgaccaacaacagtggactcggggtcccgccgaggcctccggaggggaaggggctgggaggttcggggtaccgcgtaataacgaaaggaaacgctaaacagttacagtaacagaatcgggcgcgtntgtagaaaggtagtcactagtctacaagagatagaattacaaaagtactcaactgtactctagactaaaatacgaaacacgaccgtaaagaaaacccgtaggaaccgaacgggccgttagttaaacgtttagttagggtacgtaaagaaaactaaaagggagtggtaattggtacgggtggtacgcgtagtaacg

SEQ ID NO: 361477 - DNA, 565 bp, Homo sapiens
  misc_feature: GZ8MTXP02IRIAG.21.4.A04.1.454.CMB.2.raw
  modified_base (393)..(393): a, c, t, g, unknown or other
  modified_base (415)..(415): a, c, t, g, unknown or other
  modified_base (439)..(439): a, c, t, g, unknown or other
  modified_base (452)..(452): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagctctcctgtgcagcctctgcattccaccttcagtgacccaacaacatggactggggtcccgccaggcctccgaaggggaaggggctgggagtggggtcgccgtatacaaggaaagctaacagttacagtacagaatacggcgcgtcgngtaagaaaggagttcacatcanaagagactgaattacaaagactanacttgaatcgtanaacaagtacgaacacgactaaacggaaaccgaggacgacggtacgttagtagttacgtaggtagtaacgaaacgaaaggtgtaagtagttggtaggtagtacgtcgtagtacg

SEQ ID NO: 361478 - DNA, 639 bp, Homo sapiens
  misc_feature: GZ8MTXP02F9GR2.21.4.A04.1.454.CMB.2.raw
  modified_base (215)..(215): a, c, t, g, unknown or other
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcacatggagtttgggctgagctgggttttccttgttgttattttacaaggtgtccagtgtgaggtgcagctggtggagtcgtggggganacgttggtccagccgtgggacgggtccctgagactctcctgtgcagcctctgcattcaccttcagtcgaaccacaaacatgggactggggtcccnccgaaggctccgaggggaagggctggagtgggtcgccgtaattacgaaggaaagctaaacagttacaagtaacagaatacggcgacgtcgtagtagaaaggtaagttcaaacccatactacaaagagtatagtaacttaacaaaaagacttaccgaacgtagtaacttctagtaaacctaaaagtaacgaaacgaacgtaacccgttaaacgaaaaaccgggaggtacccgaaacgggtaccgttagttaaattagtttaggaacgggttaagaaaacggaaagtaggtaaggtaggttaggtacgggtagtaggtacgtaggtaacgg

SEQ ID NO: 361479 - DNA, 586 bp, Homo sapiens
  misc_feature: GZ8MTXP02JULGR.21.4.A04.1.454.CMB.2.raw
  modified_base (302)..(302): a, c, t, g, unknown or other
  modified_base (353)..(353): a, c, t, g, unknown or other
  modified_base (511)..(511): a, c, t, g, unknown or other
  modified_base (552)..(552): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccacaacatggactgggtccncgaggctccgaggggaagggctggagtggggtcgccgtatacgaacggaanctaacagttacagtacagaagtacgcgcgtctgtaagaaagggaggtttaccaaaccctagttcctaacgaaaaggaggtaattacggaaatttaccgaaaaagtacctcgaacttgtactcctagaccaaaatgaaccagacccgtaagaaaaccgnggaacacggtctagtatacgttgtaggaacaacgaaaaggnggttaaggaagttggtcggtaggtagcgtagtcg

SEQ ID NO: 361480 - DNA, 532 bp, Homo sapiens
  misc_feature: GZ8MTXP02GC1LT.21.4.A04.1.454.CMB.2.raw
  modified_base (216)..(216): a, c, t, g, unknown or other
  modified_base (264)..(264): a, c, t, g, unknown or other
  modified_base (286)..(286): a, c, t, g, unknown or other
  modified_base (304)..(304): a, c, t, g, unknown or other
  modified_base (355)..(355): a, c, t, g, unknown or other
  modified_base (376)..(376): a, c, t, g, unknown or other
  modified_base (382)..(382): a, c, t, g, unknown or other
  modified_base (411)..(411): a, c, t, g, unknown or other
  modified_base (417)..(417): a, c, t, g, unknown or other
  modified_base (433)..(433): a, c, t, g, unknown or other
  modified_base (447)..(447): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctgggagggtccctgagactctcctgtgcagccctntgcattcacctcagtcgaccanaacatggactggggtccncaggctcgaggggagggctgggagtgggcgcgtatacgaaggaagctaacngttacagtacagaactacggngacgtntgacggaaaggacgttcacccgtatccanaaaganatagatacaaatctanatgactgagacaanagacacgacgacgaaacgacgacgacgacgtagtatagtagtagtacgaacgaagagtaagtagtagtggtagtacgtcgtagtg

SEQ ID NO: 361481 - DNA, 726 bp, Homo sapiens
  misc_feature: GZ8MTXP02FIFOQ.21.4.A04.1.454.CMB.2.raw
  modified_base (270)..(270): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagcgttgggttttccttgttgtttattttacaaggtgtccagtgtgaggtgcagctgggtggagtcgtgggggagtacgttggtccaggccgtgggacgggtccctgagctctcctgtgcagcctntgctattcctaccttgagtcgaccacaactagtgggacctggggtccccaccgaggccctaccggaagggggaacgggcgtaggggacgggttcggggtccgggaccgttaagttaaaccggaaaaggggaaacgtacctaaaagacggtttaacaaggttaacgaggaaacgtaccgggcgtccgttacgtaggtaaggaaaacgggtaacggttaccaacctactactacgaaaaggtagaagttacggtaaattaaccgaaaaaacgtacccttaacgtaaccttaggttaacttcgtaacgaaacctaaaataccgaaaacgacgtaacccgaaaacggaaaaaccggacgaaccggtaaccggtacggttagttaagttttacggtaggtaggtaacgaaaacgaaaggtaggtaaggagttaggtacgggttaggtacgtcgtaggtacg

SEQ ID NO: 361482 - DNA, 719 bp, Homo sapiens
  misc_feature: GZ8MTXP02HVKRI.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcacttcaccttcagtcgaccacaacagtggactcggggtcccgccgagggcctaccgaagggggaaggggccgtaggggaggtcggggtccgggtaccggtaagttaacgaaaggggtaaataccgtaaacagtttaacaaggttaacgagtaaacgtacgggccgtacggttctaggtaaggaaaacgggtaaggttacccgaaccctataccgtacgaaaggaagtagtacgtaattaacgtaaaagtaaacctcctaacgttacgttaattcctagaactaaagtacgaaacctaacggaccgtaaacggaaaaacccgggaggaacccggtaaccgggtacccggttaagttacgtttaaagtttcgggtaaaggttaaacggaaaacgtaaaaagggaggtaaggtaaggttgggttacggggttaagggtcggtacgtttacggtacgg

SEQ ID NO: 361483 - DNA, 758 bp, Homo sapiens
  misc_feature: GZ8MTXP02JETRO.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgatctgggttttccttgttgttattttacaaggtgtccagtgtggaggtgcagcgtggtggagtcggtgggggagtacgttcgggtccgaggtcccgtgggacgggtccctgacgcctcctccgtgtgcagccctctgctattccaccttcagtcaaccaacaacagtggacgtcgggtcccgccgaggcctccggaaggggaaggggcgtgggaggtcggggtccgaccgtaagtaacgaaaggaaagcctaaacgtagttacaagtacagaaacgtcggcgcgtacgtaggtaaaggaaagggtaacgttccaacctagtacgacgaaagagtacttaagaactttaaacgaaaaacgttaaaccttaccgtaacgttaaggttacttacccgtaggtaaaacctaaaagttaaacggaaacctaacggtaacccgttaaaaaccgggaaaaacccgggtaacgggaaaacccggtacccgggggttaaacccggtttaaggttaaacgttttaaacggttggggttaaacgggtaaaaacggaaaccgtaaaaagggtaggttaagggtaagtttagggtaggggttaggtacgttaccgtaggttaaccg

SEQ ID NO: 361484 - DNA, 567 bp, Homo sapiens
  misc_feature: GZ8MTXP02GPZRE.21.4.A04.1.454.CMB.2.raw
  modified_base (304)..(304): a, c, t, g, unknown or other
  modified_base (423)..(423): a, c, t, g, unknown or other
  modified_base (466)..(466): a, c, t, g, unknown or other
  modified_base (468)..(468): a, c, t, g, unknown or other
  modified_base (471)..(471): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctgggagggtccctgagactctcctgtgcagcctctgcattcaccttcagtgaccacaacatggactggggtaccnccaggctccgaggggaagggctggagtgggcggccgtatacaaggaaagactaacaagttacagtaacagaaataacggcgacgtacgtgtagaaaaggtaggttcaacccaattccanaaagtagattgaattaccaaaagaaactacactagtatactananaanaagaacaacgacgaacgaaacgaacgacgacgacgtagtattagtagtagtacgaacgaaagaagaagtagtaggtaggtaggtagtacgtagtag

SEQ ID NO: 361485 - DNA, 714 bp, Homo sapiens
  misc_feature: GZ8MTXP02JY7IM.21.4.A04.1.454.CMB.2.raw
  modified_base (218)..(218): a, c, t, g, unknown or other
  modified_base (269)..(269): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtggggganacgttggtccaggccgtgggacggtccctgagactctcctgtgcagcctcngctattccaccttcgagtcgaacccaacaacagttcggaccgtcggggtcccgccgagggccgtaccggaaggggtaacggggcgtaggggaggtcggggtccggtaccgttaattaaaccggaaaaggggtaaacgtacctaaacgtaaggttacaaaggttaccgagtaaacgtccggacggtcgttacgtaggtaagggaaaagggtacgttaccaacccgtatacgtacgaaaagggtatataggtaaacttaacgaaaacgtaaaccttacgtaacgttacggtaacttactacggaacttaaaagtaggaaaaccccaggtaaccccgtaaacggaaaaccgggaggaacccgtaacgggtccgttaagttagtttacgtagggtaggtaacgaaagaaaaggtgtaaggtagtggtagggttcgacgtacgtagtacg

SEQ ID NO: 361486 - DNA, 601 bp, Homo sapiens
  misc_feature: GZ8MTXP02GBVIE.21.4.A04.1.454.CMB.2.raw
  modified_base (278)..(278): a, c, t, g, unknown or other
  modified_base (472)..(472): a, c, t, g, unknown or other
  modified_base (565)..(565): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcctgttgttatttacaaggtgtcagtgtgaggtgcagctggtggagtcgtgggggagtacgttggtccagccgtgggacgggtccctgagactctcctgtacagcctctgcattcaccttnagtcgaccacaacatggacctgggtccgcaggctccgaggggaaggggctgggaggtgggtcggaccgtattaacgaaggaaacgctaaacgagttaacagtaacagacgtacggcgacgtcaggtaaggaaagggtacggttacaaccgtatctaacgaagagtatgaattacgaaaagtactacatagttancgtagacaaatacgaaacacgtaccgaaggaaaaccgagggaaccgtacggaccggttaagtagtttataggtaggtaaacgaacgaaaaggngtaggaagtggtaggtacggtagcgttaggaccgag

SEQ ID NO: 361487 - DNA, 702 bp, Homo sapiens
  misc_feature: GZ8MTXP02I2F2K.21.4.A04.1.454.CMB.2.raw
  modified_base (328)..(328): a, c, t, g, unknown or other
  modified_base (559)..(559): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgacgtactctccgtgtcgcacgtccctctgctattccaccttcgacgtcgaacccaacaacagtcggaccgttcggggtcccnccgaacggccgtaccggaagggggaacggggcgtaggggtaggttcggggtccggtaccggttaaagttaaaccggaaagggtaaaacgtaccgtaaacgtaacggtttaacaaggttaacgaaggtaacgttaccgggccggtacgtcgtaggtaagggaaaagggtaacggttaccaacgtatacctagaaagagtactagtaacttaacgaaaagtactactacgttntactacagactaaaatacgaacgacgtaccgtaaacggaaaccggagaccgtacgggtaccgttagttaagtttacgttaggaaggtaacgaaaacgtaaagtggtaaggtagtacggtcgggtagtcgacgttacggtaacg

SEQ ID NO: 361488 - DNA, 569 bp, Homo sapiens
  misc_feature: GZ8MTXP02FHB31.21.4.A04.1.454.CMB.2.raw
  modified_base (290)..(290): a, c, t, g, unknown or other
  modified_base (308)..(308): a, c, t, g, unknown or other
  modified_base (365)..(365): a, c, t, g, unknown or other
  modified_base (467)..(467): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtcgcagcctctgctattccaccttcagtcgaccanaacatggactggggtccnccaggctccgaggggaaggggctggaggtgggtcgcgtattacaaaggaacgctaanagttacagtaccgagaaagtacggcgtcgtctggtagaaaagggtagttcaacccatctacgaaagagattagaattacaaaaagtacctacaactgtactntagacaaatcgaaacagaccgtaagaaaaccgagacacggacctgttattagtgtaggtaacgaaacgaaaggtagtggattaggtggtagtagctgtaacg

SEQ ID NO: 361489 - DNA, 599 bp, Homo sapiens
  misc_feature: GZ8MTXP02GH0FS.21.4.A04.1.454.CMB.2.raw
  modified_base (297)..(297): a, c, t, g, unknown or other
  modified_base (313)..(313): a, c, t, g, unknown or other
  modified_base (371)..(371): a, c, t, g, unknown or other
  modified_base (387)..(387): a, c, t, g, unknown or other
  modified_base (392)..(392): a, c, t, g, unknown or other
  modified_base (587)..(587): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccaggccgtgggacgggtccctgagactctcctgtgcagcctctgcattccaccttcagtcgacccacaacngtggactcggggtccnccgaggcctaccgaggggagggctggaggtcgggtcgccgtatacgaaggaagctaanagttacagtacagtanacggngcgtctaggtacggaaaaggtagtcaaccatcacgaagtagatagtaactacaaaagtacacgactagtactcgagacaaaagtcgaaaacgtcaccgtaaaggaaaaccggacgtacccggacgtacgttagtaatttagtagggtaggtaaacaaaacgaaaagtggaaggtagttagggaggttcgggtaancgttaggtaacg

SEQ ID NO: 361490 - DNA, 580 bp, Homo sapiens
  misc_feature: GZ8MTXP02I1CUN.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggagggtccctgagactctcctgtgcagcctctgcattcaccttcagtcgaacccacaacatggactggggtcccgccgaggcctccgaggggaaggggctgggaggtcgggtcggcgtattacgaaggaagctaaacgagttacagtacagaactacggcgcgtcgtagtagaaaggtaggttcaacatctacaagagatagattacaaaagtactcgactgtatctagacaaagtcgaaacacgacctaaaggaaaccgaggacgcggtaccgtgttaattagttagtacggtaagaaaacgaaaggtaggtaaggagttggtacgggtaggtactcgtagtacg

SEQ ID NO: 361491 - DNA, 814 bp, Homo sapiens
  misc_feature: GZ8MTXP02JFQC1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgtttatttacaaggtgtccagtgtgaggtgcagctgggtggaggtcgtgggggagtacgttggtccaggccgtgggacgggtccctgacgactctcctgtgcagcctctgcattcctaccttcagtcgaacccaacaacagtcggacgtcggggtccccgccgagggcctaccggaagggggaacggggcgtggggaggttcggggtccgggtaccgtaaagtttaaccgaaaaggggtaaaacgtaccgtaaaacgtacggtttaaacaaaggttaacgaaggtaaacgtaaccggggcggtccgttacggtaggtaaacgggaaaacgggtacggtttacccaaaccctagttacctaacgaaaaggagtaagttaggtaaacttaacaaaaacgttaacctacgtaaacgtttaggtacctttacgtacggtaaacctaaaagttaccgaaaacgaccgtaaccccgttaaaacgggaaaaccccgggaacggggtaacccgaacccggggttcccggtttaaaaggttttaacctttaaacgggtttcgggtaaaacggggttaacgaaaaaaccggtaaaagggttaaggggtaaggtaacggttacggggtacgggggtacggtaacggtcgttaggtaaaccgg

SEQ ID NO: 361492 - DNA, 609 bp, Homo sapiens
  misc_feature: GZ8MTXP02JYNRE.21.4.A04.1.454.CMB.2.raw
  modified_base (311)..(311): a, c, t, g, unknown or other
  modified_base (400)..(400): a, c, t, g, unknown or other
  modified_base (564)..(564): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagacctctcctgtgcacgccctctgcattccaccttcagtcgaccacaacatggacgtgggtcccnccgaggcctccggagggaggggctgggaggtggggtcgccgtatacgaaaggaacgactaacagttacagtacagacgtacggctcgtntgtagaaaggtagtacaccatctacgaagagataggtaattacgaaagactctaactgtactctagactaaagtacgaaactacgacctaaacggaaaaccggaggaccgaacgggtccgtagttaacgtttaggttacggaaggttaacgaacgtaaaaaggnggtaggtaacgtgggtaggttaggtaccgtcggtagttcgaaacg

SEQ ID NO: 361493 - DNA, 677 bp, Homo sapiens
  misc_feature: GZ8MTXP02GXHYH.21.4.A04.1.454.CMB.2.raw
  modified_base (266)..(266): a, c, t, g, unknown or other
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctntgctattccaccttcagtcgaccacacagtggactcggggtcccncaggcctaccggaggggaaggggctaggggaggtcggggtcgccgtaagtacgaaaggaagctaacgagttacagtaacagaactcgggcgcgtcgtaggtaggaaaaggtacgtaccaaccatcctagaagagataggaacttaacgaaagtaactacacttagtacttctagaactaaagtacgaaaccgaacggtaccgtaaacggaaaacccggtaacgggaaaccgaaccgggggttaccgttaaggtttaacgtttaacggtttacgggttaaacggttaaacggaaaacgtaaaaaggggtggttaacgggtaaaggtttggggtacgggttacggggtagtccggttagttaaaccgg

SEQ ID NO: 361494 - DNA, 590 bp, Homo sapiens
  misc_feature: GZ8MTXP02GHK5U.21.4.A04.1.454.CMB.2.raw
  modified_base (217)..(217): a, c, t, g, unknown or other
  modified_base (268)..(268): a, c, t, g, unknown or other
  modified_base (311)..(311): a, c, t, g, unknown or other
  modified_base (355)..(355): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttggtcccagccgtgggacgggtccctgagactctcctgtgcagcctntgcattcaccttcagtcgaccacaacagtggactggggtcccnccaggcctcgagggaggctggagtgggtcgcgtatacaaggaanctaaacagttacagtacagaatacggcgcgtctggagaaagggtacgtcaaccgatctacgaagagtatggaacttacgaaaagtaccttcgaacttgtacttcgtagaactaaaatgaaaactaggacctaaaggaaaaccggagaccgacggtcgttagttaattacgttggagggttaaacaaaacgaaaggtggtaaggtacgttgggtacgggtaggtacgcgtagtacg

SEQ ID NO: 361495 - DNA, 752 bp, Homo sapiens
  misc_feature: GZ8MTXP02JDB46.21.4.A04.1.454.CMB.2.raw
  modified_base (216)..(216): a, c, t, g, unknown or other
  modified_base (267)..(267): a, c, t, g, unknown or other
  modified_base (281)..(281): a, c, t, g, unknown or other
  modified_base (608)..(608): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagccgtgggacgggtccctgagacctctcctgtgcagcctntgcattccaccttnagtcgaaccaacaacagtggactcggggtcccgccgaggcctaccggaagggggaacggggtccgtaggggacgggttcggggtccggaccgttaaagttaacggaaagggaaacgtacctaaacgtagtttaacaaggttaacaggaaacgttaccggggccgtaccgttagtagggtaaacggaaaacggggtaacgttcccaaacccgtagttacccgtaaacggaaaggtaaagtagttaacgtaaactttaaaccgaaaaaacggtcccttaaacgtaccgttagtaaaccttcgtaggaaacctaaaagtcggaaaacccncggtaaccccgtaaaaggaaaaacccggtacgggaaaccgtaccgggtacgtttaagtaactttaacggttaggtaacgggtaaaacgaaaacgtaaaaggtggtaaggtaattgggtaccggggtagacgtcgtaggtaaccg

SEQ ID NO: 361496 - DNA, 922 bp, Homo sapiens
  misc_feature: GZ8MTXP02H6O9F.21.4.A04.1.454.CMB.2.raw
  modified_base (263)..(263): a, c, t, g, unknown or other
  modified_base (324)..(324): a, c, t, g, unknown or other
tcagtcgtcgctcgcacgaccggtgctcgatttagagtagtgatcaggggagctctgagagcggagccccagccccagaattcccaggttgttttcatttggtgatcagcactgaacacagaggactcaccatggagtttgggctgagcttgggttttccttgttgttatttacaaggtgtccagtgtgagtgcagcgtggtggagtcgtgggggagtacgttggtccagccgtgggacgggtccctgagtacctctcctgtncagccctctgctacttccaccttcagtcgaacccacaactagtcggaccgtcggggtcccnccgacggccgtccggaagggggaacggggcgtaggggtacgggtcggggtaccggtaccggttaaagtttaaacggaaaacggggtaaaacgtaacccgtttaaaacgtaaacgggttttaaaccgaacggtttaaaacccgaaggggtaaaccgtttaaaccgggggcccggttaccgggtttaaccgttaggggtaaaacggggtaaaaacggggttaaaccggggtttacccaaacccggttaaacttaacccgttaacggaaaaagggttaagttaacgttaagtaaactttaaaaccgaaaaacgttaaacccttactaaccgtttaaagttacgtttacctaaacgtaacgtaaaaacgttacggaaaaccgtaacccggtaacccgtaaaacgggaaaaaaaccccgggtgggtaaaaccccgtaacccgggggttaacctttaggggttttaaaaacttttacgggttaaggggttaaaaccgggtttaaaacgaaaaaccgggttaaaaaggtacggggttaagggtaaacgggtttacggggttagggggtttaagtacccgggttacgttttaaacgggaaacccgg

SEQ ID NO: 361497 - DNA, 815 bp, Homo sapiens
  misc_feature: GZ8MTXP02FZQ2W.21.4.A04.1.454.CMB.2.raw
  modified_base (216)..(216): a, c, t, g, unknown or other
  modified_base (314)..(314): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagccgtgggacgggtccctgagactctcctgtgcacgcctctgcctatccaccttcagtcgaaccaacaacagtggactggggtcccnccgaggcctaccggaggggacgggctgggacgggttcgggtccggaccgtaaagttaacgaaaacggtaaacgtacctaaaacgtaacgtttaacgaacggttaaaccgaagggtaaactacccgggggtaccgtaccgttacgttagggttaaagggaaaaacgggtaacgggtttaccaaacccgtattacccgtaacgaaaaggtagtaagttaacggtaaactttaaacgaaaaaacggtaccttaaaccaacgtttaggtaactttccgtaaggtaaacctaaaaagtaccgggaaaacttaaccggaacccggttaaaacggaaaacccggtaacgggaaacccgtacggggtaacccggttaaggttttaaaccgtttaaacggtttaacgggtttaacggaaaacggtaaaaaccgttaaaaggggacgggtttaagggtaaaggttcggggttttaaacgggggtaggttacggttacggttacggtaacgg

SEQ ID NO: 361498 - DNA, 702 bp, Homo sapiens
  misc_feature: GZ8MTXP02JMQQ2.21.4.A04.1.454.CMB.2.raw
  modified_base (260)..(260): a, c, t, g, unknown or other
  modified_base (279)..(279): a, c, t, g, unknown or other
  modified_base (284)..(284): a, c, t, g, unknown or other
  modified_base (296)..(296): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgtgttatttacaaggtgtcagtgtgaggtgcagctggtggagtcgtgggggagtacttggtccagtccgtgggagggtccctgagactctcctgtgcagcctntgcatcactcagtgaccanacagnggactgggtccncgaggcctcggaggggacgggtctaggggaggtcggggtcgaccgtaagtacgaaaggaagtactaacgtagttacaagtaacaggtaataccgggcgtaccgtagtaggtaaggaaaacgggggtaacgttccaaaccccggtattacccgtaaaggaaaaggggtttaagtaccgttaaagttaaaccttaaacgaaaacgttacctactacgttacgtactacggtacaaacgtaaagacgaaaccgaacggtaacccgaaaacggaaaccggtacggtaacccggtaacgttacggttaagtttaacgttaagggttacggtaaacggtaaacgaaaaacggtaagggtaggtaaaggttaggttccggggtagggtaacgttacggtcgggttaacgtacg

SEQ ID NO: 361499 - DNA, 732 bp, Homo sapiens
  misc_feature: GZ8MTXP02G8VD2.21.4.A04.1.454.CMB.2.raw
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccaggccgtgggacgggtccctgagactctcctgtgcagcctctgcattccaccttcagtcaccacaacagtggactgggtcccnctagggcctaccggagggggaacgggcgtaggggacggtcggggtacccggcgttaaagttaacgaaaggggtaaaacgtacctaaaaccgtaaggtttaaccaaggttaaaccgaggggtaaacgtaaccgggcgtacgtctaagggtagaaaaacgggtacgttaccaacctagtactacgaaagtagactaggtaacttaacgaaaaagtaccttacaaacgttacgttaacgttccctaaggaacctaaaaagtaccggaaaacacgggtacccgttaaaacggaaaaaccccgggtagaaacccgtaaccgggggtacccgttaaaggtttaagtttacgttaggggtaacggttaaacgaaaacgaaaaggagttaaggggattggggtagggtacggtacgtacgtggtaaccg

SEQ ID NO: 361500 - DNA, 661 bp, Homo sapiens
  misc_feature: GZ8MTXP02GOLS8.21.4.A04.1.454.CMB.2.raw
  modified_base (217)..(217): a, c, t, g, unknown or other
  modified_base (271)..(271): a, c, t, g, unknown or other
  modified_base (285)..(285): a, c, t, g, unknown or other
  modified_base (290)..(290): a, c, t, g, unknown or other
  modified_base (301)..(301): a, c, t, g, unknown or other
  modified_base (317)..(317): a, c, t, g, unknown or other
  modified_base (381)..(381): a, c, t, g, unknown or other
  modified_base (412)..(412): a, c, t, g, unknown or other
  modified_base (461)..(461): a, c, t, g, unknown or other
  modified_base (553)..(553): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtggggganacgttggtccaggccgtgggacggggtccctgagtacctctcctgtgcagcctngctacttcaccttnagtanaacccacaacngtggactggggtcccncgaggccctcggaggggaagggcgtgggaggtcgggtccgtaccgtaattaaccgaaaggaacnctaaagagttacaagtacaggaactacgggngtaccgtgtaggaagaaagggtaacgttccaaccagtactagaaagtanattagaaacttaacgaaaacgccgttactaaacttggttaactacgtacggaaaacttaagacgaaaccacgacctaaaacggaaaaccggngaaacgtaccggtacgttaagttattagttaggtacggtaaacgaaacgtaaaaggtgggtaacggtaaggttacggttagggggtaggtacgtccgttaggaacccg

SEQ ID NO: 361501 - DNA, 731 bp, Homo sapiens
  misc_feature: GZ8MTXP02JLIMX.21.4.A04.1.454.CMB.2.raw
  modified_base (332)..(332): a, c, t, g, unknown or other
  modified_base (717)..(717): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtgggggagacgttggtccagccgtgggacgggtcccctggacgtaccttctccgtgtcgccacgtccctctcgctacttccaccttcgagtcgaaccaacaacagtggaccgtcggggtccccnccgacggtacctaccggaagggggtaacggggccggtaggggtacgggttcgggggtaccggtacccgttaaagttaaccggaaacgggtaaacgtacctaaaacgtacggtttaaccaaggttaaccgaggtaaacgtaacggggccggtaccgtacgttagggtaaagggtaaaacggggttaacgttcccaaaccctattcccgaagaaaaggtagtaatacggtaaacttaaaccgaaaaacgtaccttacgtacttagtaacttcgaagacctaaaagccgaaacacgaccgtaaaggaaaacgacgggacccacgggtacttagttaacttagtggtaaggaacaaaactaagggagtggagtttagggcggggttaancgtacgtacgtacg

SEQ ID NO: 361502 - DNA, 832 bp, Homo sapiens
  misc_feature: GZ8MTXP02H7V6F.21.4.A04.1.454.CMB.2.raw
  modified_base (795)..(795): a, c, t, g, unknown or other
  modified_base (803)..(803): a, c, t, g, unknown or other
  modified_base (823)..(823): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgtttgttattttacaaggtgtccagtgtgaggtgcagcgtggtggagttcgtgggggagtacgtttggtaccgaggcccgtggggaacgggttccccgttaggacggtacctccgttcccgttgtcggcctacggtccctcgtgcctaactttccctaacctttccgaaggtccgaaccaaccaaaccagtcggtaccgtcggggtccccaccgacggcctaccggaagggggaacggggtcgtaggggaggttcggggtaccggtaccggttaaagttaacggaaaacgggtaaaacgtaccgttaaacgaacgttttaacgaacggttaaccgaagtaaaaacggttccgggtaccgtaccggtttacgtaacggggtttaaagaaaaaaccgggtaacggggttttaacccaaacccgttaaacgttaccgttaaaaccggaaaacgtaaacggtaagtaagggtaaactttaaaccgaaaaacggtaaaccctaaacgttaaccggttaattaacgttacgtacggaaaacctaaagttaacgaaacgaacgtaaccgaaacggaaaaccgcggaaccgtaccgggtaactagtttagtaacgttagtacggttaaacgaaagtaaaagngtaaggtntacggttagaggtttacggngttacgacg

SEQ ID NO: 361503 - DNA, 712 bp, Homo sapiens
  misc_feature: GZ8MTXP02IOBI2.21.4.A04.1.454.CMB.2.raw
  modified_base (235)..(235): a, c, t, g, unknown or other
  modified_base (242)..(242): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaagacgccaccctctcctgcagctccagccagaatntccaganctactacatacgccctaggtaccagcaagaacgcccgtggccacggcctcccgacggttcctcatcctagtcgcgttccggccccacggacgggccctagtcggacactcccgaagacgtaggtccaggtcggacgtagggttcggggtctacgggggaactaacggtaccctttaccgaccgttctacaacttctaagttacgactacgtacgtagggacctacgttaacgtaaagtgtttaccgacgtaaagtttggttaactttaccgttgggttacacggtaccgtaaaggtttacgtaacggggttaacttaccgttaaccgtttccggttacggtttacccgggtttccgggaaacccgggttaaaacgggaacccgttaaaaggggtaaacgtaaaacgtaacggaaaaaccgtacgttaagggtcgtacgttacggacgtaaaccctgtttaccggtttccg

SEQ ID NO: 361504 - DNA, 738 bp, Homo sapiens
  misc_feature: GZ8MTXP02IUXEJ.21.4.A04.1.454.CMB.2.raw
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagtacttggtccagccgtgggagggtccctgagactctcctgtgcagcctctgctattcaccttcagtcgaccaacaacagtggactcggggtcccnccgacggtcctaccggaaggggaacggggcgtggggaggtcggggtaccggccgtaagttaaccgaacggaaaacgctaaacgagttaacacgtaacaggtaactacgggcgtacgtcgtaggtaaggaaaggtacgttcacctatctacaaagagatgtaattaacgaaaagtacctacgaacgtttagtaacttaccgtacgaaacgtaaaacgttacggaaaacctaaccgggtaacccgtaaaaacggggaaaaaccccggtaagggaaacccgtaaaccgggggtaccggtttaggtttaaaacggttttagtttaacggggtaaagggtaaaacggtaaaaaccgtaaaaggggttaaggttaagggtaaaaggttcgggggttttaaggggacgggtttaacgtcggttacggtaaccgg

SEQ ID NO: 361505 - DNA, 665 bp, Homo sapiens
  misc_feature: GZ8MTXP02IGRTH.21.4.A04.1.454.CMB.2.raw
  modified_base (655)..(655): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagcgtggtggagtcgtgggggagtacgttggtccagccgtgggacgggtccctgagactctcctgtcgcagcctctgcacttccaccttcagtacgacccaacaacagtcggacgtcggggtccccaccgaggcctaccggaaggggaacgggtcgtagggaggtcggggtccgaccgttaagtaccgaaaggaaacgtctaaacgtagttaacagtacaggaagtacggccgtcgtacgtaggtaaggaaacgggtaagttccaactagtccagtaaagagtaatagtaacttaacgaaaaagtacctacgtaacgttgtaacttacgtaacgaacttaaaagacgaaactacgaacctaaacggaaaaccggagtaaccgaaccggtacgtagtttaatacgttaggaacggttaaagaaaacgtaagtaggtaaggtagtaggtagggtagtacgngttacgaacg

SEQ ID NO: 361506 - DNA, 677 bp, Homo sapiens
  misc_feature: GZ8MTXP02JNZ4M.21.4.A04.1.454.CMB.2.raw
  modified_base (302)..(302): a, c, t, g, unknown or other
  modified_base (350)..(350): a, c, t, g, unknown or other
  modified_base (355)..(355): a, c, t, g, unknown or other
  modified_base (419)..(419): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtcccnccaggcctcgaggggacgggctgggagtgggtcgcgtatacaacgganctaanacgttacagtacagaatacggcgcgtctggtagaaagggaacgttcaccgtatctacaaagatntagtactttacgaaaacgtaactccacgttagtacttaccgtagaaccgtaaaagttacgaaaaccgaccggtaacccgttaaacggggaaaaaaaccccggtggggaaaacccgacccgggggttaacccggttagtttaaaaccgtttacgttaggggttacgggttaaaacgaaaacccggtaaaaaggtggggtaacgggtaaatttcgggggttacgggggtaggtttaaacccggtggttacgttaaccggg

SEQ ID NO: 361507 - DNA, 746 bp, Homo sapiens
  misc_feature: GZ8MTXP02GDM41.21.4.A04.1.454.CMB.2.raw
  modified_base (306)..(306): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcccgtggagggtccctgagactctcctgtgcagcctctgctattcaccttcagtcgaccacaacatggactcgggtccnccaggcctccgaggggaacggggcgtggaggtcgggtccggaccgtaagttaacgaaagggaaacgtacctaaacgtacgttaacgaagttaacgaggtaaacgtacgggccgtaccgtacgtaggtaacgggaaaacgggtaaacgggtttccaaacccgtaagttaccccgtaagaaaacggtacgagttaggtaaactttaaaccgaaaaacggtacccttaacgtaaccgttaggttaacttaccgtacgtaaaccgtaaaataccgggaaaactacggaaccccgttaaagggaaaaccggaccgggaaacgtaacccgggtaccgtacggtttagtttaaacgttaggttacggttaaacggaaaacgtaaaaggaaagggtaacggtagttaaacggggtcgggttaaggtaacggtaccgttaggttaccgg

SEQ ID NO: 361508 - DNA, 613 bp, Homo sapiens
  misc_feature: GZ8MTXP02JVF2A.21.4.A04.1.454.CMB.2.raw
  modified_base (306)..(306): a, c, t, g, unknown or other
  modified_base (572)..(572): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtccctgagactctcctgtgcagcctctgcattcaccttcagtgaccacaacatcggactggggtcccnccgaggcctccgaggggaaggggctgggaggtggggtcggaccgtattaacgaaggaagctaaacagttacagttacaggaactacggcgcgtctggtaggaaaaggaggttcaccgatcacaagagataggaacttacaaaagactacactagtaatcgtagaccaaaagttcggaaacacgtaccgtaaaggaaaaccgaggaacccaacggggtcccgttaaggttacttaaggttagtacggggtaaagaaacgtaaaaggnggttaaggagtttagggacgggttggaacgtggtacggtag

SEQ ID NO: 361509 - DNA, 741 bp, Homo sapiens
  misc_feature: GZ8MTXP02HTTIE.21.4.A04.1.454.CMB.2.raw
  modified_base (202)..(202): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanacgccaccctctcctgcagctccagccagaatatccagagctaactacatacgcctggtaccagcaagaacgcctggccaggcctcccgaggttcctcatcctatcgcgtcgggtccccacggacgggcccacgtcggactactaccccgagtaccgtacgggtttccaagggttcggacggtaggggtttcgggggtacgttcggggggaacctaacgggtccctttacccgaacttcccgtactaacgtcccttaaagtttacggacgtaacggtaaacccgttggggtaacgtccccggttaaggtaaacggtacgtttttccggaacgtaggtttacggtttaatttaccgttagttacgaacggtacgtaagttacggtaggttaaacgtttcgtaacccgttcgttcgggttaccggtttaccgggaaccggtaaacgggggtaaacccgtaaaagggtaaacgtaaaagttaacggaaaacggtaacgtaacgggtaacggtctacggtaccctaaccgtagttctttaccg

SEQ ID NO: 361510 - DNA, 728 bp, Homo sapiens
  misc_feature: GZ8MTXP02JISY8.21.4.A04.1.454.CMB.2.raw
  modified_base (334)..(334): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttgggtccaggcccgtgggacggggtccctgacgacctctccgtgtcgcacgtccctgtcgctacttccaaccttcgagtacgacccaacaaccagtcggacgtcggggtcccnccgaggcccgtaccggaaggggaacggggtcgtgggagggttcggggtccggaccgttaagttaacgaaaaggggtaaacgacctaaacaggtttacaagttacaggaagtacgggccgtacgtgtaggtaaggaaaaggggtacggtttccaaacccgtagttcctaacgaaaggaataacgtagtaaacgtttaaagaaaaaccgtaacttactaaacgttcggttaaacttccgagtaaacctaaaagtcgaaaccgtacgtaaacccgtaaacggggaaaaaccccggaggtacccgaaacgggtccgttagtttaacgttaaggtttgtaagggtaacaaaacggtaaaagtggtaaggtagttagtggggtagtacgcgtagtaaccg

SEQ ID NO: 361511 - DNA, 723 bp, Homo sapiens
  misc_feature: GZ8MTXP02JPZ5D.21.4.A04.1.454.CMB.2.raw
  modified_base (263)..(263): a, c, t, g, unknown or other
  modified_base (540)..(540): a, c, t, g, unknown or other
  modified_base (661)..(661): a, c, t, g, unknown or other
  modified_base (710)..(710): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccggtgtgaggtgcagctggtggagtcgtgggggatacgttgtccagccgtggacggtccctgagctctctgtgcagcctntgctacttccaccttcagtcgaacccaacaacagtcggaccgttcgggtcccgacccgacggtcctacccggaagggggtaacggggcgtacggggtaggttccgggggtccggtaacccgttaaagttaaaccggaaaggaaaacccgtacgtaaaaccgtagttaacgaagtaacgaaacgtaggtaccgggcgtacgtacgtaggtaaacggaaaagggtacgttacccacgtactacgagaagaacgtatagaacttaacgaaaacgtacctnttaaacgtgttaaactcgtaacgaaacctaaaagtccgaaaaccgtacgaacccgtaaaaggaaacccgacggtaaccgtaccggacggtttaagtatttaaggtacggtaaaggttaaanaaaacggtaaaaggtggtacggtaagttgggggtaacggtgttaacggngttacggacgaag

SEQ ID NO: 361512 - DNA, 717 bp, Homo sapiens
  misc_feature: GZ8MTXP02HOX0J.21.4.A04.1.454.CMB.2.raw
  modified_base (266)..(266): a, c, t, g, unknown or other
  modified_base (310)..(310): a, c, t, g, unknown or other
  modified_base (370)..(370): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcgtgggggagacttggtccagccgtgggagggtccctgagactctcctgtgcagcctntgcattcaccttcagtcgaccacaacagtggacgtcgggtcccnccgacggcctccggaggggaagggcgtgggaggtgggtccgcgtaagtacgaaaggaaanctaaactagtaacagtaacagtaacgtacgggcgtccgttacgtaggtaagggaaaacgggtaacgggttccaaacccgtattaccgtaacgaaaaggtagtaataggtaaactttaacgaaaaacgtaacctactaacgttacgttaattaccgtagtaaaccgaaaaagttaccgaaaaccgaccggtaacccgtaaacgggaaaaaacccggtacgggaaccgaaccggggtaccgtttaggttaaactttacggtttagggtaacggtaaagaaaaccggtaaaaaggtgggttaagggtagttaggggttacggggtaggttaacgtccggtttagtaccgg

SEQ ID NO: 361513 - DNA, 828 bp, Homo sapiens
  misc_feature: GZ8MTXP02F97AV.21.4.A04.1.454.CMB.2.raw
  modified_base (596)..(596): a, c, t, g, unknown or other
tcagtcgtcgctcgcacgaccggtgctcgatttagagtagtgatcaggggagctctgagagcggagccccagcccagaattcccaggtgttttcatttggtgatcagcactgaacacagaggactcaccatggagtttgggctgagcttgggttttccttgttgttatttacaaggtgtccagtgtgaggtgcagcgtggtggaggtcgtgggggagtacgttggtccgagccgtgggacgggtcccgtgacgactcctcctgtgcagcctctgcctattccaccttcgagtacgaacccaacaaactagtacgggtacttcggggtttaccccgacccgaacgggtccccgtacccggaaaggggggaaacgggggtcgttacggggaacggggtttcgggggtcccggggtacccggttaaacgtttaaccggaaaaggggtaaaacgtaccttaaaacgtacgtttaaacgaaacggttaaccgaggtaaaacgtacccggggtccgtaccggttccgtagggtaaacggaaaagggggtacgttaccaaccctagttaccagaaaaggacgtatagtaaattaacgaaaaanccttaaacaccgttaaggtactacgtacgaaactaaaagtacggaaaactacggaacccgttaaaacggaaaaacccgggtacggtaaacccggaacgggttacccggtttaaggtttaaaattttaacggggtttaggtaaaggggttaaaaccgaaaaacggttaaaaagggtaggggtaaggtaggttaggggttaccgggttaaggggtacgtacggttacgtaacgg

SEQ ID NO: 361514 - DNA, 747 bp, Homo sapiens
  misc_feature: GZ8MTXP02HZUV1.21.4.A04.1.454.CMB.2.raw
  modified_base (215)..(215): a, c, t, g, unknown or other
  modified_base (274)..(274): a, c, t, g, unknown or other
  modified_base (304)..(304): a, c, t, g, unknown or other
  modified_base (366)..(366): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttcctgttgttatttacaaggtgtccagtgtgaggtgcagctggtggagtcgtggggganacttggtccagcctggagggtccctgagactctcctgtgcagcctctgcattcaccttnagtcgaccacaacatggactcggggtcccncgacggctccgaggggacggggtctgggagtcggggtcgaccgtattacgaaggaagctaanagttacagtacaggaaactacgggctcgtacgtaggaaggtaaaacgggacgttccaaacccgtattaccgaacgaaaggagtaagttacgtaaacttaacgaaaaaacggtaccttacccgtaaacgttaggttaacttaccgtagggtaaacctaaaaagttcgaaaacccgaacggttaaccccgtaaacgggaaaaaaaaccccgggcggaaaacccggtacccgggggttaacccgtttaagggtttaaaaccttttaacggttacgggggtttaaacggtaaacggaaaacggtaaaaaacgggtgggttaaaggggtaccgtttaggggttaacgggggtcggggttaaactcccgggtttaggggtaaacccg

SEQ ID NO: 361515 - DNA, 792 bp, Homo sapiens
  misc_feature: GZ8MTXP02FRAOJ.21.4.A04.1.454.CMB.2.raw
  modified_base (192)..(192): a, c, t, g, unknown or other
  modified_base (262)..(262): a, c, t, g, unknown or other
  modified_base (299)..(299): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtncagctggtggagtcgtgggggatacttggtccagcctgggacgggtccctgagactctctgtgcagcctngcattcacttcagtgaaccacaacatggactgggccncaggtctaccggagggacgggctgggaggtggggtccggaccgtaagttaaccgaaaggaaacgtcctaaacgagtttaacgagtaaaccaaggtacgtaccggggctacgggttaccgtggttaaagggaaaacgggttaaacgggtttaccgaaacccgtaacgttaccgtaaaccgaaaacggtaagtaaacgtgggtaaaactttaacgtaaaaacgggtaaaaccttaccgtaaacgttacgggttaaacttaccggttaacggtaacctaaaacgttaacggaaaaaccctaacgggtaaaccccgttaaacggaaaaaaccccgggtaacgggaaaccggtaaacccggggtacccgttaacggttaaacgtttaaggtttaccgggttaaagggttaaacggtaaaaccggtaaaaaaggtacggttaaggggtaaacgttggggtagggttacgggtaggttacgttacggtacggttaaaccg

SEQ ID NO: 361516 - DNA, 758 bp, Homo sapiens
  misc_feature: GZ8MTXP02F33FL.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggttttccttgttgtttattttacaaggtgtccagtgtgaggtgcagctgggtggagtcgtgggggagacgttggtccaggtccgtgggacgggtccctgacgtactctcctgtcgcacgcctctgctacttccaccttcagtcgaacccaacaacagtcggtaccgtcggggtaccccgccgacgggaccgtaccgggaagggggaaacggggtccgtaggggtacggggttcggggtccggtaccgttaaagttaacggaaaacgggtaaacgtacctaaaacgtagtttaaacgaagttaaccgaggaaacgtaccgggcgtaccgttacgtagggtaaagggtaaaacgggtaaacggttccaaaccctagtaccgtaacgaaaagagtattaacggtaaactttaaaccgaaaaaacgtaccttaccaaacgttaggttaactcgtagaaacctaaaagtacgaaaacgacggtaaccgaaaacggaaaaccggaggtaaaccgacgggtaccgttaggttattaacggttaggtaacggtaaagaaaacgaaaggttaggtaaggtacgtagggtacgggtaggtagtacggtaggtaacg

SEQ ID NO: 361517 - DNA, 813 bp, Homo sapiens
  misc_feature: GZ8MTXP02GJK20.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccaggtcccgtgggacgggtcccctggacgtacctctccgtgtgcacgcctctgctattccaccttcgagtcgaaccctaacaaacgtacgtcgggaccgttcgggggtcccccgaccgtaacggggtcccgtaccccgggaaggggggtaaacggggtcccgtagggggtaacggggttcgggggttccggtacccggttaaagtttaaacccggaaaaaggggtaaaaccgtacccgttaaaaacgtaacggttttaaaccgaaacggttaaacgaacgggtaaacgttaaacccggggtccggtacggttaccgttaggggtaaacgggtaaaaacgggggttaaacggtttcccaaacccgtaagttacccgttaacgaaaaggtacgtaagttaaggtaacttaaacgaaaaacgtaccttacgtacgttagttaactcgtaggaacctaaagtacgaactacggtaccgtaaacggaaaaccgtacggaaccgacggtccgtaagtttacgttaagtagggtacggtaaagaaacgaaaaggtcgtggtatgggttacgggtagtaacgtcgttaggtaacg

SEQ ID NO: 361518 - DNA, 637 bp, Homo sapiens
  misc_feature: GZ8MTXP02GMGMC.21.4.A04.1.454.CMB.2.raw
  modified_base (298)..(298): a, c, t, g, unknown or other
  modified_base (314)..(314): a, c, t, g, unknown or other
  modified_base (356)..(356): a, c, t, g, unknown or other
  modified_base (362)..(362): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagtacttgggtcccaggtcccgtggggacgggtccctggagacctctcctgtgcagcctctgctattcaccttcagtgaccanaacatggactgggccncaggctcgagggaggctggagtgggcgcgtatacgaagaaanctaaanagttacagtaacagatacggcgacgtctaggtagaaaagggtaagttaccaacctagtactacgaaaagagtataggaaacttaccgaaaaagacttacaacgttagtaactcagtaacaaaataccgaaacacgtaccctaaaggaaaacccgaggaaaccgaaccgggtcccgttaaagttagttaaacgttggggttaacggtaaaagaaaaccgtaaaaaggtacgggtaaggaagttgggtacggggtaggtaacgtccgtaggtaaccg

SEQ ID NO: 361519 - DNA, 761 bp, Homo sapiens
  misc_feature: GZ8MTXP02GLQYQ.21.4.A04.1.454.CMB.2.raw
tcagtcgtcgctcgcacgaccggtgctcgatttagagtagtgatcaggggagctctgagagcggagccccagcccagaattcccaggtgttttcatttggtgatcagcactgaacacagaggactcaccatggagtttgggctgagcttgggttttccttgttgtttatttacaaggtgtccagtgtgaggtgcaggctgggtggagtcgtgggggagtacgttggtccagccgtgggacgggtccctgacgactctcctgtgcacgccctctgctacttcaccttcagtcgaaccacaacagtcggactcggggtcccgccgacgggcctaccggaagggggaacggggcgtagggacgggttcggggtaccgggtaccgttaaagttaaaccgaaaaggggtaaaactaccgtaaaacgtaggtttaaacaaggttaaacaggtaaacgtaccggggacggtccgttacgtagggttaaagggaaaacggggtaaacggttaccaaaccctaagtacgttaacgaaaaggtaaagacttaaggtaaaactttaaccgaaaaaacgtaccttacctaacgttacggttaatccgtaagaaacctaaaagtacgaaaacacgtaacccgtaaacggaaaaccggacggaaacggtaccgggtaccgttaggttatttaacggttacggtaagggttaaacgaaaagaaaaggtaggttggtaaagttgggttaggggtaggtaacgtcggtacggttaacg

SEQ ID NO: 361520 - DNA, 602 bp, Homo sapiens
  misc_feature: GZ8MTXP02F5N2X.21.4.A04.1.454.CMB.2.raw
  modified_base (265)..(265): a, c, t, g, unknown or other
  modified_base (279)..(279): a, c, t, g, unknown or other
  modified_base (310)..(310): a, c, t, g, unknown or other
  modified_base (374)..(374): a, c, t, g, unknown or other
  modified_base (380)..(380): a, c, t, g, unknown or other
  modified_base (402)..(402): a, c, t, g, unknown or other
  modified_base (439)..(439): a, c, t, g, unknown or other
  modified_base (457)..(457): a, c, t, g, unknown or other
  modified_base (464)..(464): a, c, t, g, unknown or other
  modified_base (504)..(504): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggccagccgtgggacgggtccctgagactctcctgtgcagcctntgctattcaccttnagtcgaccacaacatcggacctggggtcccnccgtaggcctaccggagggggaggggctggggaggtcggggtccggaccgtaatacgaaggaanctaaanagttacagtacagaatcgggcncgtataggtaagaaagggtagtcaccgatcacaaganatagatacaaaagtctanactgtanctgaactaaatcgaaacagaccctaaaggaaaaccccggnggaaccgtacggtcgttagttagttagttacggtaaggtaaacgaaaacgtaaaggtggtaacggaagttggggtaggtgtaccggtcgtagttaacg

SEQ ID NO: 361521 - DNA, 680 bp, Homo sapiens
  misc_feature: GZ8MTXP02GIQ73.21.4.A04.1.454.CMB.2.raw
  modified_base (207)..(207): a, c, t, g, unknown or other
  modified_base (216)..(216): a, c, t, g, unknown or other
  modified_base (258)..(258): a, c, t, g, unknown or other
  modified_base (267)..(267): a, c, t, g, unknown or other
  modified_base (271)..(271): a, c, t, g, unknown or other
  modified_base (277)..(277): a, c, t, g, unknown or other
  modified_base (326)..(326): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagttttggggctgagcggtggttttcgtgtaggtacgtttacaaggtgtcagtgtgaggtgcagctggtggngtgtggggngcgttggtcgagcgtggagggtccgtgagactctcctgtgcncgctctgcnctcnctcagnaccacacagtggacgtcggtccgcgacggcgtcgagggaggggcgtggnggtggggtcggcgtaagttaacgaacggaaagacgtaacgtaagtacgtaagtaacgagaaagtaacggacgtccgtacgtaggtaaggaaagggtaaagtacgtaacctactacgtacgaaagaagtagtagtaattaacgaaaacgtaaactactaacgttacgttattacgtacgaacgtaaactaaacgaaacgtaacgtaaccgtaaacggaaaaccggaaacggtaacggaaccggtaccggttacggtttaaacgtttaacgtttaaggttaacggtaaacggaaaacgtaaaaggtaaaggtaaggtaaggtagggttagggttaggtacggtacgtacggtacgg

SEQ ID NO: 361522 - DNA, 626 bp, Homo sapiens
  misc_feature: GZ8MTXP02G11VD.21.4.A04.1.454.CMB.2.raw
  modified_base (216)..(216): a, c, t, g, unknown or other
  modified_base (305)..(305): a, c, t, g, unknown or other
  modified_base (349)..(349): a, c, t, g, unknown or other
  modified_base (613)..(613): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagccgtggagggtccctgagactctcctgtgcagcctctgctattcaccttcagtcgaccacaacagtggactgggtccncgaggcctcgagggaggctggagtgggcgcgtatacgaaggaanctaaagagttacagtacagtaactacggcgtacgtcgtaggtagaaacgggtaacgttcaaaccctatacgtaacgaaaggatacgttgtaaacttaacgaaaaacgtaccttccgacgttagtaacttccgagtaaccaaaagtacgaaacgacgtaccgaaacggaaaaccggtacgggaccacgggtactttagtaatttagttggaacggttaacgaaaacgtaaaggtggtaaggtacgtaggggttaggtacgggtancggttaggtaacg

SEQ ID NO: 361523 - DNA, 544 bp, Homo sapiens
  misc_feature: GZ8MTXP02FKXLX.21.4.A04.1.454.CMB.2.raw
  modified_base (262)..(262): a, c, t, g, unknown or other
  modified_base (348)..(348): a, c, t, g, unknown or other
  modified_base (353)..(353): a, c, t, g, unknown or other
  modified_base (374)..(374): a, c, t, g, unknown or other
  modified_base (433)..(433): a, c, t, g, unknown or other
  modified_base (470)..(470): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggaggggtccctgagactctcctgtgcagcctntgcattcaccttcagtcgaccacaacatggactgggtcccgcaggcctcgaggggagggctggagtgggcgcgtataacgaggaanctaanagttacagtacagaatacggngtcgtctaggtagaaagggtagtcacctagtctacaagagatgaagttacaaagactanactgtatctagacaaatgaaacagactacgaaaacgnggacacggtcgtagtattaatgtacggtagaacgtaaagaaggtggtaataggtagggtgtacggcgtagtacg

SEQ ID NO: 361524 - DNA, 656 bp, Homo sapiens
  misc_feature: GZ8MTXP02HNS4K.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtggaggtgcagctgggtggagtcgtgggggagacttggtccaggccgtgggagggtccctgacgactctcctgtcgcacgcctctgcattccaccttcagtcgaacccaacaacagtcggacgtcggggtcccgccgaggcctccggaaggggtaacggggcgttggggaggtggggtaccgccggttaagttaacgaaaggaaacgacgtaaataaggtttacaaaggttaccagggtaaactaccgggacgtccgttagtacgggtaggaaaaagggtaacggttacaaacctagtactaacgaaagagtatagaaattacaaaagtactactacttagtatctagactaaaatacgaaacagaccgtaagaaaaccgtaaggacacgggtcgtagttattagttagtacggtaagaaacgaaaagtgtaaggagttaggttcggtaggtaacggtcgttaggtacg

SEQ ID NO: 361525 - DNA, 837 bp, Homo sapiens
  misc_feature: GZ8MTXP02HNFX0.21.4.A04.1.454.CMB.2.raw
  modified_base (263)..(263): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcacgcctcngcattccaccttcagtcgaccaacaacatcggacgtcgggtcccgccgaggcctacccggaagggggaacgggggcgtaggggagggttcggggtaccgggtaccggttaagttaaaccggaaaagggtaaaacgtaccgttaaaacgtacgtttaaacaaggttaaaccgaaggtaacgttaaccggggccggtacggttaccgtaagggggttaagggaaaaacggggttaacggggtttacccaaacccgtaacgttaccgttaaccggaaaaggtaaggtaaacgttagggtaaactttaaaccgaaaaaacggttaaacccttaccgtaaaaccgtttggttaaacttacccgttaagaaacccttaaaaaggttaacggaaaacccgaacgggtaaaccccgttaaaacggggaaaaaaccccggtacgggaaacccgtaaccggggtacccggtttaagtttaacgttttaaaggttacggttaaggggtaaaacgtaaaacgaaaaagggtaggttagggtaagttggggtagggtttagggtagtcggttacggtacgtaaccgg

SEQ ID NO: 361526 - DNA, 800 bp, Homo sapiens
  misc_feature: GZ8MTXP02JNW08.21.4.A04.1.454.CMB.2.raw
  modified_base (317)..(317): a, c, t, g, unknown or other
  modified_base (750)..(750): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtcgcagcctctgctacttccaccttcagtcgaccaacaacagtcggacgtcggggtcccnccgaggcctccggaagggggaacggggccgtaggggacgggttcggggtccggtaccggttaagtttaacggaaaagggtaaacgacctaaacgtaacggtttacaaggttaacgaggtaaacgtccggggacgtaccggtctagggtaagggtaaaacgggtaaccggtttaccaaacccgtagttaccgtaaacgaaaagggtacgtaacgtacgggttaaacttaaccggaaaaaaacgtacccctttaaagtaacccgtttaagggttacttaccggttaaggaaaacccttaaaaagttccggaaaaccgaccgggttaaccgtaaaaacccgggaaaaaacggtaccccggtaacggaaaccccggggtttaccgttaagtttacgtttaaaggttacggtaagggttaaaacgaaacgtaaaaggnggtaagggtaaacgttgggttacgggggtagtaggtacgtaggtaaaccg

SEQ ID NO: 361527 - DNA, 636 bp, Homo sapiens
  misc_feature: GZ8MTXP02JQWG2.21.4.A04.1.454.CMB.2.raw
  modified_base (262)..(262): a, c, t, g, unknown or other
  modified_base (275)..(275): a, c, t, g, unknown or other
  modified_base (303)..(303): a, c, t, g, unknown or other
  modified_base (350)..(350): a, c, t, g, unknown or other
  modified_base (408)..(408): a, c, t, g, unknown or other
  modified_base (415)..(415): a, c, t, g, unknown or other
  modified_base (459)..(459): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagctctcctgtgcagcctntgcattcaccttnagtcgaccacacatcggactgggtaccncaggctccgaggggagggctggagtgggcgacgtatacgaaggaacntaacgagtacaggtacagaatacggcgcgtctaggtaggaaaaggagttccaaccctntacctanaaagagatagaattacaaaagtactacacttagtactacgtaanaactaaagtacgaaacctacggaccgtaaacggaaaaccggaggtaacccgaacggggtaccgttaggttaacgtttaacggttagggttaaacgggtaaacggtaaacgtaaaaggggtaggttaagggtacggttaggggttacgggttaacgggttacgtacggttacggtacg

SEQ ID NO: 361528 - DNA, 813 bp, Homo sapiens
  misc_feature: GZ8MTXP02FQVBB.21.4.A04.1.454.CMB.2.raw
  modified_base (268)..(268): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctggagactctcctgtgcagcctcngcattccaccttcagtcgaaccaacaacagtggacgtcggggtcccgccgaggcctaccggaggggaacggggcgtggggagggttcggggtaccgggaccgttaagttaaccgaaaaggggtaaaacgtaccgtaaaacgtaacggtttaaacaaacggttaaccgaagggtaacgtaaccgggggacccgtaccggttaccgtagggttaaagggaaaacggggtaaacgggtttacccaaacccgtaattaccgtaaacgaaaggtaagtaacgttaaggtaaatttaacccgaaaaaagtaacccttacgtaaccttacgggttaaattaccgttaacgaaacctaaaaagtaccggaaaacctaaccggtaaacccgttaaaaccggaaaaccgggaacggtaaaccgaacccggggtacccgtttaagggttaaattttaggtttaaacgggtaacgggttaacgtaaaaacgaaaagggttaacggttaaggaaagtttaggggtacggggttaggtaacggtccgttgggttaaccg

SEQ ID NO: 361529 - DNA, 779 bp, Homo sapiens
  misc_feature: GZ8MTXP02H6KFR.21.4.A04.1.454.CMB.2.raw
  modified_base (462)..(462): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagcgtggtggagtcgtgggggagtacgttggtccaggccgtgggacgggtccctggagtactctccgtgtgcgacgccctctcgctacttaccacccttacgagtacgaaccaacaactagtggacgtcggggtcccaccggaggccgtccggaagggggaacgggcgtggggagggtcggggtccgggtaccgttaagttaacgaaaacgggaaagtactaacagttaacaggttaacagaaacgtacgccgtcgtacgaggtaanaaaggtacgtacaacactacacgaagagtaagtagtaataacaaaacgtaaactacgtacttacgtacttacgtagtaaaccgtaaagttaacgaaaaccgaacggtaacccgtaaaacgggaaaaaccccggtaaaccggggaaaacccgtaacccggggttaacccggttaaacgggttttaaacggttaaacggttttaacggttaaacgggttaaaacggaaaaccggtaaaaaaggggtaaagggttaagggtaacggttacggggttacggggttaacgggttaacggttaggttaccccccggttaaagg

SEQ ID NO: 361530 - DNA, 644 bp, Homo sapiens
  misc_feature: GZ8MTXP02IRCOJ.21.4.A04.1.454.CMB.2.raw
  modified_base (456)..(456): a, c, t, g, unknown or other
  modified_base (492)..(492): a, c, t, g, unknown or other
  modified_base (499)..(499): a, c, t, g, unknown or other
  modified_base (632)..(632): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgtttattttacaaggtgtccagtgtgaggtgcagctggtggagtcgtgggggagtacgttggtccagccgtgggacgggtccctgagactctcctgtgcagcctctgcattccaccttcagtcgaccaacaacatgggactcggggtcccgccaggcctccggaggggaacgggcgtgggaggtcggggtcggccgtaagttacgaaaggaaacgctaaacgagttacgaagtacagaaatacggcgccgtcgtaggtagaaaagggtacgttcaccatctacgaaagtacgngtagtaattaacaaaacgacttacactagtaacttnttacganaaaaatcgaaacacgaccgtaaaacggaaaacccgagggaacccgacggtaccgttagttaatttaggttaggttaacggtaagaaaaacgtaaaaggtaggtaacggtaaagttgggtacgggttagggtancgtaggtaaccg

SEQ ID NO: 361531 - DNA, 737 bp, Homo sapiens
  misc_feature: GZ8MTXP02IJ2EK.21.4.A04.1.454.CMB.2.raw
  modified_base (270)..(270): a, c, t, g, unknown or other
  modified_base (287)..(287): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagtacttggtccagcccgtgggacgggtccctggagactctcctgtgcagcctcngctattcaccttcagtnaaccacaacagtggactgggtccgccgaggcctaccggaggggaacggggctaggggaggtcggggtccggaccgttaagttaaccgaaaggggaaaccgtacctaaacgaacggtttaaacaacggtaaaccgaaggtaacgggttaccggggccgtaccggtttaccgtaaggggttaacggggaaaaaggggtaacggttacccaaaccctagtactacgaaagagtatagtaaactttaacgaaaacgtaaacctactaacgttagtaacttacgtacgaactaaaactacggaaaacacgtaccgtaaacggaaaaaacccggacgggaaccgtaaccgggtccgttaaggttatttaaggttacgggtaaagggtaaacgaaaacgtaaaaaggtaggtagggtaagttggtacggggttaggtaagtcgtaggtacggtaacg

SEQ ID NO: 361532 - DNA, 609 bp, Homo sapiens
  misc_feature: GZ8MTXP02GCIB9.21.4.A04.1.454.CMB.2.raw
  modified_base (262)..(262): a, c, t, g, unknown or other
  modified_base (290)..(290): a, c, t, g, unknown or other
  modified_base (308)..(308): a, c, t, g, unknown or other
  modified_base (505)..(505): a, c, t, g, unknown or other
tcagtcgtcgctcgcacgaccggtgctcgatttagagtagtgatcagggggagctctgagagcggagccccagccccagaattcccaggtgctttcatttggtgatcagcactgaacacagaggactcaccatggagtttgggctgagctgggttttcctgttgttattttacaaggtgtccagtgtgaggtgcagctggtggagtcgtgggggatacttggtccagcctgggacggtccctgagactctctgtgcagcctntgcattcaccttcagtcgaccacgaacngtggacgtcggggtcccncgaggcctccggaggggagggctgggagtgggcgccgtataccgaaggaagctaacagttaacagtacaagaacgtacgcgctagtagagaaaggtagttacactatctacgaaagacgatagaattacgaaaagtaactctaacgtagtataccaggaaccaaagtaggaaacacgtacccgaacgaaaaaccggnggaaacccacgggtaccgtagttaacgttagttacggtacggtaaacgaaacgtaaaaggaaggtacggtaagtcgggtagggttaggaacccggtacgttagg

SEQ ID NO: 361533 - DNA, 688 bp, Homo sapiens
  misc_feature: GZ8MTXP02I44O3.21.4.A04.1.454.CMB.2.raw
  modified_base (198)..(198): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcacctgtcttgtctccgagggaancgccaccctctcctgcagcctccagccaagaatactccagacgtcctactacatacgccgtaggtaccaggcagaacgccgtggccaggtccctacccgtaggttccccatacttcctagtcggacctccggggtaccccacggaccgggccccacggttcggaccctacgtaccccgaaaggtacccgtacgggtttaccgaagggtcggtacggtagggttacggggtccgtagggggacctacgggttacctttacccgaccgtttcgtacctaacgttactaacgttacgcgtaaaggcgttacgggacgtcccgtaaggtacgttacgttaccgacttaggttacgtacttacgtgtactaggtactagtacgtaggtacttacacgttgtacggttccgtacggacgtaaacggtaccgtaaaggttaacaacgtaacggaaccgtagtcggtacgtagtacgactaacgtcgttacgtttacg

SEQ ID NO: 361534 - DNA, 857 bp, Homo sapiens
  misc_feature: GZ8MTXP02FOMCU.21.4.A04.1.454.CMB.2.raw
  modified_base (335)..(335): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagtacgttgggtccaggcccgttgggacgggttcccctggagtaccgtcctccgtgtcgcacgcccgtctgcctattcctaccttcagtcgaacctacaacagtcggacgtgggtcccncgacggcctaccggaggggaacggggctaggggaggttcggggtacccggccgttaaacgttaacggaaaacggggtaaaacgtcctaaaacgtaacggttaaccgaacggttaaacgaggaaacgttaaccggggcggtccgttacgtagggtaaacggggaaaagggtaaacggttaccaaccctatacccaaggtaaagagaacgttagtaaacgttaacaaaaacggtaacttaacgtaaacttaggtaacttacgtaacggtaaaaccgtaaagtaaacggaaaaccctaacgggaaacccgtaaaaccggggaaaaaaaccccgggtcgggtaaaaaccccggacccgggggtaaccgtttaaaacggttaaaggtttttaagtttaaccgggttaaaagggggttaaacgaaaaaaccgggttaaaaaggggtaaacgggttaagggttaaaggggtttaacggggtttacgggggttaacgggtttaaaacggtcggttacggggtttaaaccg

SEQ ID NO: 361535 - DNA, 574 bp, Homo sapiens
  misc_feature: GZ8MTXP02HQ3N7.21.4.A04.1.454.CMB.2.raw
  modified_base (279)..(279): a, c, t, g, unknown or other
  modified_base (288)..(288): a, c, t, g, unknown or other
  modified_base (307)..(307): a, c, t, g, unknown or other
  modified_base (395)..(395): a, c, t, g, unknown or other
  modified_base (472)..(472): a, c, t, g, unknown or other
  modified_base (486)..(486): a, c, t, g, unknown or other
  modified_base (501)..(501): a, c, t, g, unknown or other
  modified_base (539)..(539): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttgggtccaggcctgggagggtccctgagactctcctgtgcagcctctgcattcaccttnagtgaccanaacatggactcggggtccnccaggcctccgaggggaggggctgggaggtggggtcgaccgtattacgaaggaaagctaacagttacagtacagaaatacggcgcgtntggtagaaagggaacgtttcaacccgtatcgtacgaaagagaatggacttaacgaaaagtactacgacttgtatcgngacaaatgaaaccngacctacgaaaacgngacacggcgtagtattagtgtaggaagacgtaaaaggngtaagggtactgggtcggtaggtacgacgttgacg

SEQ ID NO: 361536 - DNA, 816 bp, Homo sapiens
  misc_feature: GZ8MTXP02HXG4C.21.4.A04.1.454.CMB.2.raw
  modified_base (286)..(286): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagcgtggtggaggtcgtgggggagacgttggtccagccgtgggacgggtccctgagacttctcctgtcgcagcctctgctattcaccttnagtcgaccacaacagtggacgtcgggtcccgacgaggcctccggaagggggaacggggcgttaggggacgggtttggggccggtacgtaggttaaacgtttaaccgaaaagggtaaaacgtactaaaaaccgtagtttaaaccgaagttaacgaagggtaaaactaccggggaccgttacgtacgtaggttaaaggggaaaaacggtaacggtttccaaaccctattacccgtaaagtaaaaggaggtaattacggtaaactttaaacgaaaaaacgtacctttaccgaaactttacggtttaataccttaacgaaaacttaaaaacgtaaacgaaaccggtaaacgtaaaccggtaaaaccggaaaaaccgggaaaaccgggtaaaccggtaaaccgggttaaccggtttaaacggtttaaacgtttaaaggtttaacggttaacgggttaaaacggtaaaacggtaaaaggtaaagggtaagggttaagggttagggtagggttacgggttaacggttacggttacgg

SEQ ID NO: 361537 - DNA, 788 bp, Homo sapiens
  misc_feature: GZ8MTXP02IL7C4.21.4.A04.1.454.CMB.2.raw
  modified_base (596)..(596): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccaggcctgggagggtccctgacgactctcctgtgcacgcctctgcattccaccttcacgtacgaacccaacaaacagtcgggacctcggggtccccgcccgacgggcctacccggaagggggaacgggggtccgtagggggaggttcgggggtaccgggtaccggttaaagttaaccgaaaacggggaaaacgtaccgtaaacgtaacgtttaacgaaaggtaaccgaagggtaaacgtaaccgggaccggtcggttaccgttagggaaacgggtaaaacggggtaaacgttaccaaacccgtaatacccgtaacgaaagagtaataggtaaacttaacgaaaacgtaacctacgtaacgttgtaacttntacggaactaaaagtacgaaacgaacggtaacccgtaaaacgggaaaaacccggcggaaacccggaaaccgggtaccgtttaaggtttaaagtttaacgttagggtaaacgggttaaacgaaaacgtaaaaggtaacgggtggtaaacggttagggttaggggtaagggttacgtaccggttaggtaaccgg

SEQ ID NO: 361538 - DNA, 542 bp, Homo sapiens
  misc_feature: GZ8MTXP02GMK78.21.4.A04.1.454.CMB.2.raw
  modified_base (197)..(197): a, c, t, g, unknown or other
  modified_base (286)..(286): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccagggaangccaccctctcctgcagctccagccagaatatccagagctactacatagcctggtaccagcagaagcctggccaggctcccaggttccncatctatgctgggtccccagagggcccactggcatcccagcaggttcagtgcaggtggtctggggacagacttcacctctacatcattacgcaaggactggaacgtccgtagtaacgtactttacgctaggttgttaattactgtacagactagtagtggtaattcaccttcgtgtcgttcggacaaggggtacctaaaggtacgtaaagtacgaaacgtaacgtggtcggtacgtacgcgtacacgttcgttacg

SEQ ID NO: 361539 - DNA, 613 bp, Homo sapiens
  misc_feature: GZ8MTXP02J1VFE.21.4.A04.1.454.CMB.2.raw
  modified_base (309)..(309): a, c, t, g, unknown or other
  modified_base (384)..(384): a, c, t, g, unknown or other
  modified_base (505)..(505): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccagccgtgggacgggtccctgagactctcctgtgcagcctctgctattccaccttcagtgaccacaacatgggactggggtccncgaggctccgaggggagggctggagtgggcgcgtatacgaaggaaagctaacagttacagtacagaatacgggcncgtctggtagaaaggagttcacatctacaaagagatagtaattaccaaaagtactactaacgtacgttatcgtagaactaaaacgtagaaaacctaggtaccccgaaacggaaaaacccgngggtaaacccgacgggtaccggttagttaacgttagttaggtaggttaacgaaaacgtaaaaaggcggttaaggaacgttgggtaggtaggtaagtcgttaggtaacg

SEQ ID NO: 361540 - DNA, 748 bp, Homo sapiens
  misc_feature: GZ8MTXP02IEV4D.21.4.A04.1.454.CMB.2.raw
  modified_base (321)..(321): a, c, t, g, unknown or other
tcagtcgtcgctcgcacgaccggtgctcgatttagagtagtgatcaggggagctctgagaccgcggagccccagccccagaattcccaggtgttttcatttggtgatcagcactgaacacagaggactcaccatggagtttgggctgagctgggttttccttgttgttattttacaaggtgtccagtgtgaggtgcagcgtggtggaggtcgtgggggagtacttggtccagccgtggagggtccctgagactctcctgtgcagcctctgctattccaccttcgagtcgaaccccacaacagtcggaccgtcggggtcccnccgagggcctaccggagggggaacggggccgtaggggacggttcggggtaccggaccgttaagttaacggaaaacgggtaaacgtacctaaacgtagttaaccgagttaaacgaggtaacgtaccggggccgtacggttacgtagggtaaagggtaaaacgggtaaacggttacccaaacccgtaattaccgtaacgaaaagtagtagtaagtaactttaaacgaaaagttacctactaacgttgttaactcgtaagtactaaaaacgtcgaaaccgacggaacccgtaaacggaaaaacccggtagggaacccgaccgggttaccgttagttaaacgtttacggttaggtaaagggttaaacgaaaacggtaaaaggtgggtaaggtaggttagggtacgggtagggtacgtccgttaggtaaccg

SEQ ID NO: 361541 - DNA, 654 bp, Homo sapiens
  misc_feature: GZ8MTXP02IO4TZ.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctgggaggtccctgagactctcctgtgcagcctctgcattccaccttcagtcgacccacaacatggactggggtcccgccgaggcctccgaaggggaacggggcgtgggaggtcggggtccggaccgtaagttaacgaaggaaacgctaaacagttacaagtacagaaatacggcgcgtcgtagtaggaaaagggtagttccaacctatacctacgaaaggagtataggaattaacgaaaagtacctactaacgttgtactctagaactaaaatcggaaacacggtacctaaaggaaaaacccggtacgggaacctaaccggggtccttagggtttaaatttacggtttaggtacgggtaaaagaaaacgtaaaaggtaggttaaggagttacgggttaggggtagtacggtcgtaggttaaccg

SEQ ID NO: 361542 - DNA, 771 bp, Homo sapiens
  misc_feature: GZ8MTXP02F6ZP8.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctagacgacttctccgtgtcgcacgccctctgactacttccaccttcacgtacgaaccaacaactagtcggacgtcggggtcccgacccgacgggtccctaccgggaagggggtaacggggcgttaggggacgggttcgggggtccggtaccggttaaagttaaccggaaaagggtaaacgtacctaaacgtaacgtttaacgaacgtaactaggaaacgtacggacgtccgttgtaagggtaaagggtaaaagggtaacgttaccaacccgtaattacgaaacgaaagacgtaagtacgtaaacttaaacgaaaacttactacgtaaacttggtaactccgtaataaaccaaaagtaccgaaacgtacggtaacccgtaaaacggaaacccggaacggtaaaccggtaccgggtaccgttaaggtttaaactttagggtttaacggtaaacggggttaacgaaaaacggtaaaaggtaggttaaggtaaaggttggttacgggggtagtacggtcgttaggtaaccg

SEQ ID NO: 361543 - DNA, 614 bp, Homo sapiens
  misc_feature: GZ8MTXP02GL763.21.4.A04.1.454.CMB.2.raw
  modified_base (463)..(463): a, c, t, g, unknown or other
  modified_base (529)..(529): a, c, t, g, unknown or other
  modified_base (577)..(577): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgctattccaccttcagtcgaacccaacaaacagttggaccttcggggtccccgcccgaagggccctacccggaggggaacggggctggggaggtcggggtccggccgtaagttacgaaaggaaacgctaaacagttacaagtaacgagaatacgggcgcgtctaggtaagaaagggacgttccaaccatcgtacaaaganatgaattacaaaagacttacactagtatcgagacaaaagtcgaaacagaccctaaggaaaacccgnggacaccggcgttagtatttacgttggacgtaaacgaacgaaaaaggngtaaggaattcgggtagggtacggtagcgtagtacgg

SEQ ID NO: 361544 - DNA, 604 bp, Homo sapiens
  misc_feature: GZ8MTXP02JVZSW.21.4.A04.1.454.CMB.2.raw
  modified_base (351)..(351): a, c, t, g, unknown or other
  modified_base (377)..(377): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccaggcctggacgggtccctgagactctcctgtgcagcctctgcattcaccttcagtgaccacaacatggactggggtccgccaggctccgagggagggctggagtgggcgccgtatacaaggaancaacagtacagtacagaatacggcgngtctggtagaaaaggagttacaaccgatcacgaaagtagatagaattacaaagaactcaacttgtaactctaggaactaaataggaaaccacggaccctaaaggaaaaaccccggaggaaccgacgggtacccgtaggttaattacgttagggtaaggtaacggaaaacgaaaaaggtagggttaaggacgttaggggtagggttaggtaacggtccgtaggtaacg

SEQ ID NO: 361545 - DNA, 664 bp, Homo sapiens
  misc_feature: GZ8MTXP02FMYL7.21.4.A04.1.454.CMB.2.raw
  modified_base (198)..(198): a, c, t, g, unknown or other
  modified_base (298)..(298): a, c, t, g, unknown or other
  modified_base (550)..(550): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctccgagggaancgccaccctctcctgcagctaccagccagaatatccagagctaactacatacgcctaggtaccagcagaacgcctggccaggcctcccgtaggttccctnactctagtcggcctcgggtccccacggacgggcccacgtcgggacctaaccgtccccgaaaggtaccgacgggtttccgagggttcggacgtaggggttcggggtacgtcgggggaacctacggtaccttcgaccttctactactacctaagttacgacgaacggacgttagggacgtaccgttaggaaagttctttacgacgtagttagttattacgtgtaccgagtacagttagtagggtaactttaccncgttcgttcggttaccggttacggaccggtaaacgggtaaccgtaaaagggttaagaaaacgtacgaaaacgtacgtaaggtacgacgtacgactaaccgtattccggtttacg

SEQ ID NO: 361546 - DNA, 943 bp, Homo sapiens
  misc_feature: GZ8MTXP02FKZM1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtgggggagtacgttggtcccaggccgtgggacgggtccctgacgactctcctgtcgcacgcctctgctattccaccttcagtacgaacccaacaactagtcggacgtcggggtccccgccgacgggccctacccggaagggggaacggggccgtaggggaggggttcgggggtccggggtacccgtttaaagtttaaaccggaaaaggggtaaaacgtaccgttaaaacgtaacggtttaaaccgaaacggttaaaccaaggggtaaaacgttaacccgggggaccggtaccggttaccgttaagggttaaaaggggtaaaaaacgggggttaaaccggggttttacccaaaaccccgttaaagttaccccgttaaacgaaaacggggtaaacgtaacgttaaggttaaaactttaaaaccgaaaaaaaacggttaaccctttaaccgaaaaccgttttaggttaaactccgttaagggaaaaccttaaaaaagttacggaaaaaccctacgggtaaacccccgttaaaaacgggaaaaaaacccccgggtaaggggtaaaaccccgaaaccgggggttacccggtttaaggtttaaacgttttaaacggtttacgggggttaaaacgggttaaaacggaaaaaccgtaaaaaggggttaacggttaagggggtaacgtttaagggggttcgggggttaaccgggttaaaggtccggtttaggggtaaaccgg

SEQ ID NO: 361547 - DNA, 711 bp, Homo sapiens
  misc_feature: GZ8MTXP02IOQTB.21.4.A04.1.454.CMB.2.raw
  modified_base (672)..(672): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagacgttggtccagccgtgggacgggtccctgagctctcctgtgcagcctctgcacttccaccttcagtacgaacccaacaacagtaggaccgtcggggtcccaccgaggacctaccggaaggggaacggggtcgtggggaggttcggggtaccggtccgttaaagttaaccgaaaaggggtaaacgacctaaaacgtaagtttaacgaagttaacgaggtaaacgttaacgggccgtacgttacgtaggtaaacggtaaaacgggtaaacggtttcccaaaccgtataccgttaagaaagagtagtagtaacttaaccgaaaagtaactctaacttgtaattaccagtaaaccaaagtcgaaaacgtacgacccgtaaagggaaaacccgagggaaccgaaccgggtcgtaacggtttaaatttaggtaggtaaacggtaagaaaacgtaaaagnggtaacgtagtacggtaggtacggtagtcgttacgaacg

SEQ ID NO: 361548 - DNA, 767 bp, Homo sapiens
  misc_feature: GZ8MTXP02GQGBX.21.4.A04.1.454.CMB.2.raw
  modified_base (347)..(347): a, c, t, g, unknown or other
  modified_base (756)..(756): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttactaaggtgtccagtgtgaggtgcagcgtggtggagtcgtgggggagtacgttggtccaggccgtgggtacgggtccctaggacgtaccttcctccgtgtcgcacgtcccttctgcctactttccacccttcgaagtcgaaccccaacaactagtcggaccgtcggggtccccnccgaggtccgtaccgggaaggggaacggggtcgtaggggtacggttcggggtaccggtaccgtaaagttaaccgaaaagggtaaacgacttaaacgacgtttaacgaacggttaacgaggtaacgtacggccggtacgttacgtaggttaaacggggaaaacgggttaaacgttccaaacccgtaaacgtccgtaaaacggaaaggtagtaagttacggtaaactttaaacgaaaaaccgtaaccttaccgtaacgttaacgtttacttacgacggaaactaaaagtaccgaaaaccacggaacctaaaacggaaaccggaggacccgaaccggtcttaaggttatttaacggttaggaaaggtaacgaaaaacgtaggagtaaggtagttagggtacgggtagtacgnggtacgtaacg

SEQ ID NO: 361549 - DNA, 803 bp, Homo sapiens
  misc_feature: GZ8MTXP02JOFVI.21.4.A04.1.454.CMB.2.raw
  modified_base (272)..(272): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggatacgttggtccagtccgtgggacgggtccctagacgactctccgtgtgcagcctntgctattcctacttcagtacaaccacaacagtcggactcggggtcccgccgaaggccgtaccggaagggggaaccggggcgtagggtacggggtcggggtccggtacccgtaagttaacggaaaacgggaaacgtcctaaacgagtttaacgaacgttaacaggtaaacgtaccgggcggtacgttacgtaggtaacggaaaaaggggtaccgtttaccaaacccgtattacccgaaggaaaagggaataagtttacggtaaaactttaacgaaaaaacggtaaccctttacgaaaccgtttaggttaaccttacggtacaaaaccgtaaagttaacggaaaaccctacgggaacccgtaaaacggaaaaaacccggggttggaaacccggacccgggttacgggttaatttacggttaacgtttagggggaaaggttaaaccgaaaaaacgggtaaaaggtacgggttaaggttaaagtttccggggggttaacgggttggtaaaccggttggttacggttaaacccggg

SEQ ID NO: 361550 - DNA, 695 bp, Homo sapiens
  misc_feature: GZ8MTXP02I3PPK.21.4.A04.1.454.CMB.2.raw
  modified_base (285)..(285): a, c, t, g, unknown or other
  modified_base (296)..(296): a, c, t, g, unknown or other
  modified_base (377)..(377): a, c, t, g, unknown or other
  modified_base (383)..(383): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacgttggtccaggccgtgggacgggtccctggacgactctcctgtgcagcctctgctattcaccttnagtagacccanaacagtggacctggggtacccgccaggcctacggaggggaagggcgtagggaggttcggggccgtcgtatacgaaggaacnctaaanagttaacagtaacaggaatacgggctacgtcgtaggtacgggaaaagggtacgtttccaaacccgtataccgtacgaaaaggtaagtcgtagtaaactttaaacgaaaaacgtaccttaccgaactttaggtaacttacgtaccggaaactaaaacgttcgaaaacccacggttaccccgtaaaaaagggaaaacccccgaagggggaccctaaaaccggggtccggtttagttaaatttacggttaggtaccggtaaagaaaaacgtaaaggagggttaacgaggttaggtgggtaccgtagtcgtagtac

SEQ ID NO: 361551 - DNA, 711 bp, Homo sapiens
  misc_feature: GZ8MTXP02GQYYG.21.4.A04.1.454.CMB.2.raw
  modified_base (267)..(267): a, c, t, g, unknown or other
  modified_base (281)..(281): a, c, t, g, unknown or other
  modified_base (292)..(292): a, c, t, g, unknown or other
  modified_base (312)..(312): a, c, t, g, unknown or other
  modified_base (379)..(379): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccagccgtgggacgggtccctgagtactctcctgtgcagcctntgctattcaccttnagtcgacccanaacagtggactggggtcccnccgaggcctaccggaggggaagggctaggggaggtcggggtccgtacgtaattaacgaaaggaaacnctaaacagttacaagttaacgaggtaactacgggctacgtctaggtaaggaaaagggtaacggttcaacctagtacctaagaaagtagtaataggtaacttaccgaaaaaagtacccttacgtaaacctttaggtaaattcccgtaaagaaaacgttaaacgtaacgaaaaccgtacgtaacccgtaaaacgggaaaacccgacgggaacccgacccgggttacgttagtttaaacgtttacggttaggggtaaacggtaaacgaaaacgggtaaaaggtacggtaagggtaaggttaggggttacgggtaggtaaccgtcggtaacgtacg

SEQ ID NO: 361552 - DNA, 616 bp, Homo sapiens
  misc_feature: GZ8MTXP02ICB2L.21.4.A04.1.454.CMB.2.raw
  modified_base (215)..(215): a, c, t, g, unknown or other
  modified_base (261)..(261): a, c, t, g, unknown or other
  modified_base (274)..(274): a, c, t, g, unknown or other
  modified_base (302)..(302): a, c, t, g, unknown or other
  modified_base (343)..(343): a, c, t, g, unknown or other
  modified_base (349)..(349): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctgggtggagtcgtggggganacttggtccagcctggagggtccctgagactctcctgtgcagcctntgcattcaccttnagtcgaccacaacagtggactgggtccncaggctcgagggaggctggagtggtcgcgtatacaaggaanctaacngttacagtacaggaactcggcgtcgtcgtaggtaggaaaagggtacgttcaccctagtctacgaagagactgaattacaaaagtactcacgttgtaactcgtagaactaaaagtacgaaacgacgtaccgtaaaacggaaaaccccggaggtaaaccgaacccggggtaccgttaaggttaatttaaacggttagggtaaaggtaaacggaaaacctaaaaaggtggtaagggtaaatgggttacggggtagtacgtcgtaggtacg

SEQ ID NO: 361553 - DNA, 725 bp, Homo sapiens
  misc_feature: GZ8MTXP02IVL9S.21.4.A04.1.454.CMB.2.raw
  modified_base (291)..(291): a, c, t, g, unknown or other
  modified_base (316)..(316): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagacttgggtccagccgtgggacgggtccctgagactctctgtgcagcctctgcattcaccttcagtcgaaccccanaaacagttcggacgtcggggtcccnccgaggcccgtaccggaagggggaacggggctaggggtaggttcggggtccggtacccgtaaagttaaccggaaaacggggtaaagaccgttaaacgtaaggtttaaccaaggttaaccagggtaaacgttaccggggaccgtccggttaccgtagggtaagggaaaagggtaacgggtttaccaaacccgagtacctacgaaagtagatagacttaacgaaaagtaactactaacgttagtacttcgtacgaactaaacgtagaacacggtaccctaaacggaaaaccggacggaaaccgaaccgggtaccggttagttaacgtttacggttaggtaagggtaacgtaaaacgaaaaggtaaggtaagggtagtaggggttaggggtaggttacgtcgttaggtaacg

SEQ ID NO: 361554 - DNA, 728 bp, Homo sapiens
  misc_feature: GZ8MTXP02JY13Q.21.4.A04.1.454.CMB.2.raw
  modified_base (283)..(283): a, c, t, g, unknown or other
  modified_base (313)..(313): a, c, t, g, unknown or other
  modified_base (374)..(374): a, c, t, g, unknown or other
  modified_base (580)..(580): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtatccagtgtgaggtgcagcgtggtggagtcgtgggggagtacgttcggtccagccgtgggacgggtccctgagtactctcctgtgcagcctctgcattcaccttnagtcgaccacaacagtggactggggtcccnccaggcctccggaggggacgggctagggagtggggtccggtccgtagttaacgaaaggaanctaaacgagttacagtacagaaacgtacggcgtcgtcgtagggtagaaaacggggtacgttccaacctagttccgaataaagggtagtaaacttggtaaaactttaacgaaaaacggtaaccttccgtaaagttacggttaactccgtaggaaacctaaaagtccggaaaaccgtcggtaaacccgtaaacgggaaaaaccccggngggaaaccccgaaccgggggtttacccgttaagggtttaaaccgttttaacggtcgggtttaaaagggtaaacgaaaaaccggtaaaagggttaggtaagggtaaagttcggggtacggggttaggtaccggtacgtttaggtaaccg

SEQ ID NO: 361555 - DNA, 603 bp, Homo sapiens
  misc_feature: GZ8MTXP02F4ZT9.21.4.A04.1.454.CMB.2.raw
  modified_base (303)..(303): a, c, t, g, unknown or other
  modified_base (309)..(309): a, c, t, g, unknown or other
  modified_base (350)..(350): a, c, t, g, unknown or other
  modified_base (364)..(364): a, c, t, g, unknown or other
  modified_base (556)..(556): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttggtccagcctgggagggtccctgagactctcctgtgcagcctctgcattcaccttcagtcaccacaacatggactgggtccncaggcnccgagggagggctggagtggcgcgtatacgaagaagctaanagtacagtacaganacggcgcgtctaggtacgaaaaggtacgttccaacatctagaagagatagatacaaaagactacgtactagtaacttcgagtaacaaaatcgaaacgtacggaaccctaaaggaaaaaccgacgggaaccgtaaccgggtccgttaagttaaacgtttaacgtgggttaaaggtaacaaaacggtaaaaggnggtaaggtaagtgggttaaggggtacggttaacgcggttaggtaacg

SEQ ID NO: 361556 - DNA, 766 bp, Homo sapiens
  misc_feature: GZ8MTXP02I1OHZ.21.4.A04.1.454.CMB.2.raw
  modified_base (203)..(203): a, c, t, g, unknown or other
  modified_base (244)..(244): a, c, t, g, unknown or other
  modified_base (250)..(250): a, c, t, g, unknown or other
  modified_base (300)..(300): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagcctcagccaagaatatccagacnctacanatacgcctggaccagcagaacgcctggccaggccctcccgtaggttcccnatctatcggccttcggggtccccagacgggcccctacgtcggaccaacgtccccgaagtaccgtagggtttccagggtcggcgtagggttggggttaccgtgggggacctaacgggtacctttaccgaccctttcgtacctaacttacgtaacgtttacgaccgtaaacggtaccgtaggggtaacgtcccgttaaggtaaacgggttacgttttaccggacgttaaacggtttacggttttaactttaccggtttagtaccgtaaggtaccgtaagttacggttacggggtaaacgtttccgtaacccgtttcggttacggtttacccgggttacccgggtaacccggtaaaacgggggtaaacccgtaaaaggggttaacgtaaaacggtaaacgggtaaaaccgttacggtaacgggttacggaaccgttacggaccctaaccgttaacgttccgttttaacg

SEQ ID NO: 361557 - DNA, 712 bp, Homo sapiens
  misc_feature: GZ8MTXP02HZ5OY.21.4.A04.1.454.CMB.2.raw
  modified_base (193)..(193): a, c, t, g, unknown or other
  modified_base (217)..(217): a, c, t, g, unknown or other
  modified_base (268)..(268): a, c, t, g, unknown or other
  modified_base (278)..(278): a, c, t, g, unknown or other
  modified_base (290)..(290): a, c, t, g, unknown or other
  modified_base (303)..(303): a, c, t, g, unknown or other
  modified_base (323)..(323): a, c, t, g, unknown or other
  modified_base (326)..(326): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttgggctgagctgggctttccttgttgttattttacaaggtgtccagtgtgaggtcncagctggtggacgtcgtggggganacgtttggccagccgtgggacggtccctgagctctcctagtgcagcccttngcatccactnagacacatacancggacgtcggccncaggcacggagggagggcgnggnggtggtcgtacgtaataacccggaaagaacgtctaaacgtacgtaacgagtacgaaaggtacgtaccgggtcgtacgtacgtaagtaaacgggaaacgtacctacccaacgtactaacgtaacgaaaaggtacctaagttaaccgtaaacttacgaaaaacgtaaaccgtaaccgtaacgttaacgttaacgtacgtaacgtaaacgtaaacgtaaacgtaaacgtaaccgtaaccgtaaaccggaaaaccggtaaaaccggtaaaccggtaaccggtaccggttacggttaacgttaacgttaacggttaacggtaaacggtaaacggtaaaacggtaaggtaacggtaacggttacgggttagggtacggtacgtacggtacgg

SEQ ID NO: 361558 - DNA, 739 bp, Homo sapiens
  misc_feature: GZ8MTXP02H5ZR4.21.4.A04.1.454.CMB.2.raw
  modified_base (601)..(601): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagctggtggagtcgtgggggagtacgttggtccagccgtgggacgggtccctgacgtactctcctgtcgcacgcctctgctacttccaccttcgagtccgaacccaacaactagtcggtacgtcggggtccccgcgaacggccgtccggaagggggacggggtcgtggggtagggtcggggtccgggtaccgttaagtaaacgaaaccgggaaagtacctaacgagttacaagtaacgagaaacgtacggcgtcgtacgtaggaaaggaaaggtacgtcacgtagtctaacgaaagtagtaagtgtaaacttaaacaaaacgtacctactacgttagtaacttcgaacgaactaaaaggtaccgaaacgtaacggtaccccggtaaaacgaaaaacccccggggnggaaaaccccgtaccgggtaaccggtttagtttaaaggtttacgtttaggggaaaggttaaacgaaaacgttaaaaagggtgggtaaccgggttaagtgggggttacgggttaggtacggttcgttacggggtaaccg

SEQ ID NO: 361559 - DNA, 777 bp, Homo sapiens
  misc_feature: GZ8MTXP02HCVRV.21.4.A04.1.454.CMB.2.raw
  modified_base (220)..(220): a, c, t, g, unknown or other
  modified_base (484)..(484): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgtttattttacaaggtgtccagtgtggaggtgcagctggtggagtcgtggggganacgttggtccaggccgtggacgggtccctggacgtactcctccgtgtgcagcctctgctattccaccttcagtcgaaccaacaactagtaggtaccgtcggggtccccgaccgacggtcctaccggaaggggaacggggcgtaggggagggtcggggtccgggaccgtaaagttaaccgaaagggaaaacgtactaaacgtagttacaagttacagaacgtaacgcgtacgtctaggtaagaaagggtaacgttccaaacgtanaccgtagaagaggatagtaattaacgaaaacgtactacaaacgttagtaacgttcgtaggtaactaaaaacgtacgaaaaaccgtaccggaaaccggttaaaaccgggaaaaacccgggtaaaccggaaacccgggtaaaacccggggttaccggtttaaaggtttaaaccgtttaacgggtttacgggttaaaacgggttaaaacggaaaaacgtaaaaggggtaagggttaaggggttaagttaaaggggtccggggttagggttaacggtaacggttacgggttaaacgg

SEQ ID NO: 361560 - DNA, 706 bp, Homo sapiens
  misc_feature: GZ8MTXP02GCZ6X.21.4.A04.1.454.CMB.2.raw
  modified_base (205)..(205): a, c, t, g, unknown or other
  modified_base (305)..(305): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcaagaaaccaccggagaaattgtgttgacgcagtctccaggccaccctgtctttgtctccgaggggaaanacgccaccctctcctgcagctccagccaagaatactccagagctactacatagcctggtaccagcagaacgcctgggaccaggcctcccgtaggttcccnatctatcgctcggtacccacgacgggcccacgtcggcctacgtcccgaagacctacggttccgaggtcggacgtagggtcggggttctacgggggactacggtaccgtttcacctactacaatacctattacgactaaggacgtagggacgtccgtaaggaacgttacgtttcgacgttaaggtttacgttaactttacgtggttaccacggtactaaacggttagtacgggtaacgtttacccgaccgttcgtttcggttaccggttacccgggaacccggttaaacggggaaacccggtaaaagggttaaaacggtaaaaacgtaaacgggtaaaaccgttaaacggttaaggtacggtaaccgttacggaccctaaacggtactttaccgtttaaccg

SEQ ID NO: 361561 - DNA, 739 bp, Homo sapiens
  misc_feature: GZ8MTXP02FP3YW.21.4.A04.1.454.CMB.2.raw
  modified_base (217)..(217): a, c, t, g, unknown or other
  modified_base (304)..(304): a, c, t, g, unknown or other
tcagtcgtcgctcgcacgaccggtgctcgatttagagtagtgatcaggggagctctgagagcggagccccacgccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagctctcctgtgcagcctctgctattccaccttcagtgacccacaacatggactgggtccnccgaggcctccgaggggagggctggaggtcgggtccggcgtaattacgaaggaaacgctaaagacgttacagtacaggaactacggcgaccgtcgtaggtaacggaaaagggtacggttcaaaccctagtacctacgaaagacgattaggaaacttacgaaaaacggacttaccgtaaacttaggttaactcggtactaaaaccaaaagttaccgaaaaccttacggaacccgttaaaacgggaaaaaccccggaaggggtaaccccgtaaacccgggggtaccctttaaggtttaaagtttaaccggtttaaggggtaaacccggggtttaaaagaaaaaacccggaaaaaggggtttagggtaacggggttaaacgttacgggggtttaacgggggtaggtttaaacggtcggttacgggtttaaaacccggg

SEQ ID NO: 361562 - DNA, 790 bp, Homo sapiens
  misc_feature: GZ8MTXP02F7C3A.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacgttggtccagccgtgggacgggtccctgagactctcctgtgcagcctctgcattccaccttcagtacgacccaacaactagtggaactcggggtcccgccgacggcctaccggaaggggaacggggcgtaggggagggttcggggtaccggtaccgttaaacgttaacgaaaaggggaaaacgtaccgtaaaaccgtaaggtttaacccaaaggttaaacccaagggtaaacgttaacccggggaccggtaccgttccgttaagggttaaagggaaaaacggggttaacgggtttaacccaaacccgtaacttaaccgtaacccgaaaaggtaaggtaacgttaagggtaaactttaacaaaaaaacggtaaaccttaactaaaccgttaaggttaacttaccttagaaacctaaaaagtaaacggaaaccaacgaaccggtaaaacggaaaacccggaagggtaaaccgaaccgggtaccgttagttaaagtttacgttaggtaacggtaacgtaaaacgaaaaggtaggtaaggtacgttgggtacgggtagtacgacggttagtaacg

SEQ ID NO: 361563 - DNA, 789 bp, Homo sapiens
  misc_feature: GZ8MTXP02G7ZZ1.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtgcagcctctgcattcaccttcagtcgaaccacaacagtggacgtcggggtcccgccgaggcctaccggaagggggaacggggcgtaggggaggttcggggaccggtaccgtaagttaacgaaaaggggaaacgtcgtaaaacgtagtttaaacaagttaaacgaggtaaactaccggggacgtccgttacgtaggtaaaggaaaaggggtaaccgtttccaaaccctagtccctaaggtaaaaggaaacgtagttaacgtaaactttaaacgaaaaacggtaaaccttaccaaaccgtttggtaaactttacccggagtaaaacctaaaagtaccgggaaaaccagggttaacccccgaaaaagggaaaaaccccgggacggtaaaaccccgacccgggggttaaacccttagtttaaaacggttttaacggtttacgggtttaaacggggaaaagaaaaaccgttaaaagggtaggggttaagtaaacggttggggttagggggttagtaacggtcctagggtttaaccgg

SEQ ID NO: 361564 - DNA, 699 bp, Homo sapiens
  misc_feature: GZ8MTXP02HWJ00.21.4.A04.1.454.CMB.2.raw
  modified_base (536)..(536): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccaggccgtgggacgggtccctggacgtactctccgtgtgcacgcctctgcattcaccttcagtcgaccacaacagtggacgtcggggtcccgccgaggcctaccggaaggggacgggctggggagtggggccgtacgtagtaacgaaaggaaacgactaaacgagttacaagtaacagtaacgtacggcgtcgtactaggaagaaaagggtacgttccaaaccgtattaccgagaaagagtattaggtaaacttaaaccggaaaattaacctactaaacgttagtaacgtttactaaggaaccttaaaanagggaaaaccacggttaacccgtaaaaggaaaacccccggaggtaaaccccgaaaccgggttccgttaaaggtttactaaacggtttagggtaaggtaaaaccgaaaacgtaaaaaggtggtaaggaagttgggtaccgggtagtaccgacggtttacgaacg

SEQ ID NO: 361565 - DNA, 608 bp, Homo sapiens
  misc_feature: GZ8MTXP02G3SK9.21.4.A04.1.454.CMB.2.raw
  modified_base (217)..(217): a, c, t, g, unknown or other
  modified_base (263)..(263): a, c, t, g, unknown or other
  modified_base (297)..(297): a, c, t, g, unknown or other
  modified_base (310)..(310): a, c, t, g, unknown or other
  modified_base (357)..(357): a, c, t, g, unknown or other
  modified_base (600)..(600): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccaggcctgggagggtccctgagactctccgtgtgacngcctctgctattccacttcagtcgaccactaacntggactgggtccnctaggcctcgaggggagggctggagtgggcgcgtagtacaagggaanctaacgagtaacagtaacagtaacgtacggcgacgtacgtgtaaagggaaagggtaacgtccaaacctagtactaagaagaaaggttcagtaaagtaacaaatacgtactacgtatactagtacgaataaagacgaacacggaaaccaaacgggaacgacgaccggtacggtacgtagtttagtaggttacgaacggtaagaaaacgtaggtagtaacggtaggttgggtacggtagtacggngtacgacg

SEQ ID NO: 361566 - DNA, 772 bp, Homo sapiens
  misc_feature: GZ8MTXP02H65MI.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtgggagtcgtgggggagacgttggtccagccgtgggacgggtccctgagactctcctgtgcagcctctgctattccaccttcagtcgaccaacaacagtggacgtcggggtcccgccgacgggcctaccggaagggggaacggggcgtaggggaggtcggggtaccgggacccgttaagttaaccggaaagggtaaaacgtacccgtaaaacgtaacgtttaacaaggttaaccaggtaaacgttaccggggaccggtacgttaccgtgggttaaaggaaaacgggtacggtttccaaacccgtattccgacgaaaaggagtattagaacttaaaccgaaaagtacctacgtaactttaggtaaactttcgaagtaacctaaaagacggaaaacctcggaaaccccgttaaaagggaaaaaacccccggggacgggtaaacccggtaacccgggttacggtttaaggtttaagtttaaggtacggggtaaacggtaaaacgaaaacgtaaaaggggtaggttaaggtaggttacggggttagggttacggtacgttacggttaacggtacg

SEQ ID NO: 361567 - DNA, 672 bp, Homo sapiens
  misc_feature: GZ8MTXP02J2P97.21.4.A04.1.454.CMB.2.raw
  modified_base (203)..(203): a, c, t, g, unknown or other
  modified_base (294)..(294): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggccaccctgtctttgctccgaggggaaancgccacctctcctgcagctccagccagaatatccagagctactacatacgcctaggtaccagcaagacgcctggccaggcctccagttccnatctatcgctcgggtacccacggtacgggccctacgtggacactccccgaaggaccgtacgggttccagggtcggaccgtaggtcggggtcctgggggaacctacggtaccttcaaccttctactactcctaaagttacgacccgttaagaccggttgggacgtacccgtaggtaaacgttacgtttccggagttacggttagttaacgttacgtacgttaccgaaggtaccgtaaagtttacggttaacgggtaaaccgtttccaaccgtttcgttacgggttaccggttaccgggacgaaacggggtaacctaaaaggggtaacgtaaagtaacggaaaaccgtagtcggacggtcacggtaccactacgtcttcg

SEQ ID NO: 361568 - DNA, 720 bp, Homo sapiens
  misc_feature: GZ8MTXP02JJMEQ.21.4.A04.1.454.CMB.2.raw
  modified_base (268)..(268): a, c, t, g, unknown or other
  modified_base (324)..(324): a, c, t, g, unknown or other
  modified_base (442)..(442): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagtacgttggtccagtccgtgggacgggtccctgacgtacctctcctgcgcncgcctctgctacttcctaccttcagtcgaaccacaacagtcggacgtcgggtcccncgacggcctaccggaagggggaagggtcgtggggacggttcgggtcggtaccgtaattaacggaaacggaaacgctaaacgtagttaacaagacctaaggaacgtacggcgtaccgtntagggtaaaggaaagggtacggttacaactacgtctaacgaaagtacgtaagtagtaaacgttaaaccgaaaagtaactaccgtacgttaggtacttacgtacggaacctaaaaagtccgaaaacttaccgggaaccgtaaaacggaaaaacccggacgggaacccgacgggttaacgtagttttaaacgttacgttaggggttaaaggtaaaccgaaaagtaaaagggtggttaaggtacgttaggggttagggtcgtaaccggcggttaggaaccg

SEQ ID NO: 361569 - DNA, 676 bp, Homo sapiens
  misc_feature: GZ8MTXP02GPOQ8.21.4.A04.1.454.CMB.2.raw
  modified_base (313)..(313): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacgggtccctgagactctcctgtgcagcctctgctattcaccttcagtcgaacccacaacagtggacctggggtcccncccgagggccctaccggaagggggaagggctgggaggtcggggtccggccgttaaataacgaaacgggaaagcctaaagtacgttaacaagttaacgagaaacgtaccgggcgtacgtcgtaggtagggaaaacgggtaacggttccaaaccgtattacctacgaaaaggtagtaagtagtaaactttaaccgaaaagtaaccttacaaaccgttaggtaacttactagaacaaacgttacgaaaccgtacgaccgtaaacgaaaaccggacgaacgaccgggtacgttagtaactttacgtaggtaggtaaacgaacgaaaagtggtaaggtagtagggttggtaggtacgtcgttagtacg

SEQ ID NO: 361570 - DNA, 646 bp, Homo sapiens
  misc_feature: GZ8MTXP02FYN7I.21.4.A04.1.454.CMB.2.raw
  modified_base (316)..(316): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtggaggtgcagctgggtggagtcgtggggggagacgttgggtccaggcccgtgggaggggtccctgagactctcctgtgcagcctctgctattccaccttcagtcgaccaacaacatggactggggtccnccgaggctccgaggggaacgggctgggaggtcgggtcggccgtaaagttacgaaaggaaagtctaaaacagttaacagtaacaggaaactacgggcgacgttcgtagtaaggaaaagggagttcccaacctatctacaaagagatgaattaccgaaaagactacgaactgtacttctagaacctaaaagtcgaaacgtacgacccgtaaaggaaaaacccggaggacccgaaaccgggccgtttaggtaaacttttacggttaggtacgggtaaagaaaacgtaaaaagggtggtaaggtataggggttggacggtagtcgtaggtaacg

SEQ ID NO: 361571 - DNA, 723 bp, Homo sapiens
  misc_feature: GZ8MTXP02H9E42.21.4.A04.1.454.CMB.2.raw
  modified_base (269)..(269): a, c, t, g, unknown or other
  modified_base (307)..(307): a, c, t, g, unknown or other
  modified_base (327)..(327): a, c, t, g, unknown or other
  modified_base (675)..(675): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggtagtttgggctgagcttgggttttccttgttgtttattttacaaggtgtccagtgtggaggtgcagcgtggtggagtcgtgggggagtacgttggtccaggccgtgggacgggtccctgacgtactctctgtgcncgcctctgctacttccaccttcagtcgaaccaacaacngttggaccgtcggggtcccnccgacggtccgtaccggaagggggtacgggcgtggggaggtcggggtccggtaccgtaagtaacgaaacgggaaactaccttaaacgtacgttaacgaggttaacaggtaaacgtacggcgtccgttacgtaggtaagaaaacggtacgttacaacccgtataccgtacgaaagtagtactagtaactaacgaaaagtacttacgacgttagtactacgtagtaacaaagttaccgaaaactacggtaaccgtaaacggaaaaaccggcggaacccgtaaccgggttaccgtttaaggtttaaccgtttacggttaaggggttaacggtaaacgaaaacgtaaaaggnggttaaggtaagtgggtttacgggtaggtacgtacggttacggtaacg

SEQ ID NO: 361572 - DNA, 688 bp, Homo sapiens
  misc_feature: GZ8MTXP02JK1M2.21.4.A04.1.454.CMB.2.raw
  modified_base (275)..(275): a, c, t, g, unknown or other
  modified_base (464)..(464): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttccttgttgttattttacaaggtgtccagtgtgaggtgcagctggtggagtcgtgggggagacgttggtccagcctggagggtccctgagactctcctgtgcagcctctgcattcaccttnagtcgaacccaacaacagtggacctcggggtcccgacccagggcctaccgaagggggaaggggtcctagggaggtggggtccggtaccgtaagttaacgaaaaggggaaaacgctaaaacgagttaacaagttaacagtaaactacgggccgacgtctaggtagaaaagggtagttcaaacctatctanaagtaagctagtaaattaccaaaaagtaactctaaacttgggtaaactccgtaaggaaactaaaactaaacgtaaacgaacgtaaccgtaaacggaaaaccggaaacggaaaccggaacggtaccggttaacgttaaacgttaacgttaacggttaacggtaaacgtaaaacgtaaaacggtaaaggtaaggtagtaggtaggtaggtacggtacgtacgtacg

SEQ ID NO: 361573 - DNA, 591 bp, Homo sapiens
  misc_feature: GZ8MTXP02GB8TT.21.4.A04.1.454.CMB.2.raw
  modified_base (304)..(304): a, c, t, g, unknown or other
  modified_base (381)..(381): a, c, t, g, unknown or other
  modified_base (551)..(551): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgctatccaccttcagtgaccacaacatggactgggtcccnccgaggctcgagggaggggctgggagtgggcgccgtatacgaaggaagtctaacagttacagtacagaatacgggcncgtctgtaggaaaggaaggttcaccagtactacgaaagagatgattacaaagtactacgaactgtatcgtagacaaagtagaaactacggaccctaaggaaaaccgcgggaaacgaccgggtaccgttaggttaaactttagtttaggtacgggtaaagaacgaaaaggnggttaagaaaggttcgtagggtggtagtacgttggtaacg

SEQ ID NO: 361574 - DNA, 596 bp, Homo sapiens
  misc_feature: GZ8MTXP02IEVR2.21.4.A04.1.454.CMB.2.raw
  modified_base (296)..(296): a, c, t, g, unknown or other
  modified_base (317)..(317): a, c, t, g, unknown or other
  modified_base (393)..(393): a, c, t, g, unknown or other
  modified_base (433)..(433): a, c, t, g, unknown or other
  modified_base (447)..(447): a, c, t, g, unknown or other
  modified_base (453)..(453): a, c, t, g, unknown or other
  modified_base (485)..(485): a, c, t, g, unknown or other
  modified_base (490)..(490): a, c, t, g, unknown or other
  modified_base (492)..(492): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttttccttgttgtttattttacaaggtgtccagtgtgaggtgcagctggtggagtcgtgggggagtacgttggtccagcccgtgggacgggtcccctgagactctcctgtgcagcctctgctattcaccgttcagtcacccanaacagtcggactggggtcccncaggctccgaggggaacgggctgggagtcgggtcgacctatacgaaaggaaaacgcctaaacagttacaagtaacnggtaaataccggggctcgttcgagtaggaaaagtacgttnaaccctaatcctanaaaganatcaattacgaaacaactacactatatactanacaananaacacgacgaacgaaacgaacgacgacgtacgtagtattacgttagtagtaacgaaacgtaaaggaaggtaaggtagtaggtaggtaggtacgtacgtagtacg

SEQ ID NO: 361575 - DNA, 744 bp, Homo sapiens
  misc_feature: GZ8MTXP02I8N30.21.4.A04.1.454.CMB.2.raw
  modified_base (266)..(266): a, c, t, g, unknown or other
  modified_base (312)..(312): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggatacgttggtccaggcctgggacgggtccctgagactctcctgtgcagcctntgcattcaccttcagtcgaccacaacagtcggactcggggtccccncgaggcctaccggaaggggaacgggctggggaggtcggggtaccggaccgttaaagttaaccgaaaaggggtaaactactaaaacgagttaccgaaggttaccagggtaactacgggcgtaccgtgtaggtaaggaaaacggtacgttcccaaaccctagttaccaacgaaagagtactaagtaaacttaaccgaaaaaagtcccttacgaaacgtttaggaaactttccgaataaacgaaaaacgtcggaaaaccaccgggtaacccgtaaaacgggaaaaacccgggtacgaaaaccggtaccccggggttacgtttaaggtttaaactttaacggttacgggtaaaagggtaaccgaaaaaacggtaaaaggtgggttaaggtaagttcccggggttaggggtagttaacggtccgttaaggtaaaccg

SEQ ID NO: 361576 - DNA, 664 bp, Homo sapiens
  misc_feature: GZ8MTXP02JLMOE.21.4.A04.1.454.CMB.2.raw
  modified_base (372)..(372): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagtactttgggtccaggcccgtgggacggggtcccctggacgaccttcctcctgtgcagccctctgcattcaccgttcagtgaccacaacatggactggggtcccgccaggcctccgaaggggaagggctggagtgggcgccgtatacgaaggaacnctaacagttacagtacaggtaactacgggcgaccgttgtaggtaacgaaaagggtaacggttccaaacccgtagtccctagaaagagtagtaggtaactttacgaaaaacgtaacttaccaacgttagttaactcctaggaacctaaaagtcgaaaactacgacccgtaaggaaaaacccggagggaaccaccgggtaccgttagtacctttaaggttggttaggtaaacgaaaccgaaaaggtggtaaggaaagttgggttagggtaggtaacgtccgttaggtaacccgg

SEQ ID NO: 361577 - DNA, 723 bp, Homo sapiens
  misc_feature: GZ8MTXP02IFQP2.21.4.A04.1.454.CMB.2.raw
  modified_base (216)..(216): a, c, t, g, unknown or other
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtggggganacttggtccagccgtgggaggtccctgagactctcctgtgcagcctctgcattccaccttcagtcgaaccacaacagtggactcggggtccccnccgacggccgtaccgggaaggggacgggtcgtaggggacgggtcggggtaccggtaccgttaaagtaacggaaacggtaaacgtaccgtaaacgtagttaacgaagtaacgaggtaaacgtaccgggccgtacgttacgtaggtaaaggaaaacgggtacgttaccaacctatacgtaagaagtagtattagtaactaacgaaaacgtacctacgtaacgttacgtaattaccgtagaaactaaagtaccgaaaccgtacgtaaccgtaaaacggaaaaccggacggtaaacccggtaccgggttacgtttaagtttaagtttacggtttaacgggaaacggttaaaacgaaaacgtaaaggtagggttaagggtaagtttggggtagggttaggttacccgtgttacggacg

SEQ ID NO: 361578 - DNA, 589 bp, Homo sapiens
  misc_feature: GZ8MTXP02JVZFY.21.4.A04.1.454.CMB.2.raw
  modified_base (310)..(310): a, c, t, g, unknown or other
  modified_base (357)..(357): a, c, t, g, unknown or other
  modified_base (503)..(503): a, c, t, g, unknown or other
  modified_base (540)..(540): a, c, t, g, unknown or other
  modified_base (552)..(552): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagtacttggtccagccgtgggacgggtccctgacgactctcctgtgcagcctctgcattcaccttcagtcgaccacaacagtggactgggcccncgaggcctcgaggggagggctggagtgggcgtcgtatacgaaggaanactaacagttacaagttacagaaatacgggcgacgtcgtaggtaaggaaaagggtagttaccaactatactacaaagatagtgaattacaaaagtacctactactagtatcagtacaaagtcgaaacacgacctaaggaaaaccgnggaacgacggtacgtagttagtagttggtacggtaanaacgtaaaaggnggtaacggtaagtgtaggtcgtagtcgtacgtaacgg

SEQ ID NO: 361579 - DNA, 628 bp, Homo sapiens
  misc_feature: GZ8MTXP02HHRUF.21.4.A04.1.454.CMB.2.raw
  modified_base (310)..(310): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccagccgtgggacgggtccctgagactctcctgtgcagcctctgcacttcaccttcagtcgaccacaacagtggactcggggtccnccgaggcctccgaggggaagggctgggagtgggtcgcgtagtacaaggaacgctaacagttacagtaacaggaaactacggcgcgtactggtaaacggaaagggtacgttccaaaccttacgtcgtacaaaaggtgaagtacgtaatttaaacgaaaacgtaacttccgaacttagtattccgtagaactaaatacgaaccgaacgtaccgaacgaaaaccggacgtaacgacggtaccgtagttacttaggtagttaacggaacgaaacgtaaagtaggtaaggaagtttgggacgggttagacgtacgttaggacg

SEQ ID NO: 361580 - DNA, 617 bp, Homo sapiens
  misc_feature: GZ8MTXP02FRH23.21.4.A04.1.454.CMB.2.raw
  modified_base (216)..(216): a, c, t, g, unknown or other
  modified_base (362)..(362): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtgggacgggtccctgagactctcctgtgcagcctctgcattccaccttcagtcgaccaacaacagtggactgggtccgcaggcctacgaggggagggctagggaggtgggtcggccgtataacgaaggaacnctaacagttacagtaacagagtacggcgtcgtctggtaagaaagggtagttaccacgtatactacaagagatacgtaattacaaaagtaactacaacgtagtaactcgtagaacgtaaaagtacgaaaacacgtaccgaacgaaaaccggacggaacgacgggccgttaagtaagtttagttacggtaaggtaaacgtaaacgaaaaaggtggtaggtaagttggtacggtaggtagtacgtaggtacgtaaacg

SEQ ID NO: 361581 - DNA, 606 bp, Homo sapiens
  misc_feature: GZ8MTXP02FLJMD.21.4.A04.1.454.CMB.2.raw
  modified_base (383)..(383): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattcaccttcagtgaccaacaacatggactgggtccgccgaggctccgaggggaagggctgggaggtgggtcgccgtatacgaaggaaagctaacagttacagtacagaatacggngcgtctgtagaaaggagttcaacgatctacaagagatgaattacaaaagtacctactactacgtatctaggaccaaaagtcgaaaactacgacccgtaaaggaaaaacccggtagggaaccgtaaaccgggtaccgttagttaaagtttagttagggtacggtaaaagaaaacgaaaaggtaggtaaggtaagtgggtagggttggtaacgtcgtggtaaacg

SEQ ID NO: 361582 - DNA, 688 bp, Homo sapiens
  misc_feature: GZ8MTXP02HDTFM.21.4.A04.1.454.CMB.2.raw
  modified_base (219)..(219): a, c, t, g, unknown or other
  modified_base (647)..(647): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggttgagcttgggttttccttgttgttattttacaaggtgtccagtgtgaggtgcagctgggtggagtcggtggggganacttggccagccgtggacgggtccctgagactctcctgtgcagcctctgctattcaccttcagtcgaccacaactgtcggacgttcgggtcccgaccgaggccgtaccggagggggaagggtcgtaggggagggttggggtccgggtaccgttaagttaaaccggaaagggaaacgaccttaaacgtacggttaacacggttaacaagggtacgtaccgggggcaccgggttacagggtaacgggaaaagggtacggttacaaccgtattaccgagaaagagtatagtaattaacaaaagaacctagtaaccttaggtaactcagtaaaccaaagttaacgaaacgtacgaaccggaacgaaaaaccggcggaaacgaccgggtcgttagttaacgttagttacggttaggaacgtaaagtaaaaggnggtagtaaggtggtacggtagtaggtcgtagtacggtaacg

SEQ ID NO: 361583 - DNA, 640 bp, Homo sapiens
  misc_feature: GZ8MTXP02FTHRU.21.4.A04.1.454.CMB.2.raw
  modified_base (263)..(263): a, c, t, g, unknown or other
  modified_base (279)..(279): a, c, t, g, unknown or other
  modified_base (286)..(286): a, c, t, g, unknown or other
  modified_base (306)..(306): a, c, t, g, unknown or other
  modified_base (454)..(454): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtggacggtccctgagactctctgtgcagctntgctatcacttcagtnaacccanaacagtggactcgggtcccncgaggcctaccggaggggacggggctgggaggttcgggtaccggcgtaaattaccgaaagggaaacgactaaacgaggttacaagtaacagtacgacggcgcgtacgtaggtagaaaggtaggttaccaacgtatacctagaaagagntagtaattaacgaaaagtactacgatacgtatatacgaactaaaagtacgaaacacgtaacctaaagggaaaacccgtaaggaaccgaccgggtacgtaaggttaatttacggttaaggtacggtaaacgtaaaacgaaaaggtaggtaaggtagtacgggtaggttaggtaagcgttaggtaacg

SEQ ID NO: 361584 - DNA, 803 bp, Homo sapiens
  misc_feature: GZ8MTXP02GWY35.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccaggccgtgggacgggtccctgagactctcctgtgcagcctctgcattcaccttcagtgaccacaacagtcggacgtcgggtcccgccgacgggcctaccggaagggggaacggggtcgtaggggaggtcggggtaccggtaccgtaaagttaaccgaaaggggtaaaacgacctaaaacgaggtttaaaccaaggttaacaggtaaacgtacggggtccgacgttcgtagggtaaacggtaaaacggggtaacgtttaccaaacccgtattcccgtaaacgaaaaggtaggtattaggtaaactttaaaccgaaaaaacggtaccttaccgaaactttagggttaactttcccaaggaaaccctaaaagttaaccgaaaacgacgggtaaccccgttaaaaaggggaaaaaacccccgggaggggtaaaaccccgtaccgggggttacgtttaaagggtttaactttaacggtttaaggggtaaacggtaaaacggaaaaacggtaaaaggggttacggggtaaggttaaggtttagggggtgggggttaaccggtaaggtacggtttacgggtaaccg

SEQ ID NO: 361585 - DNA, 624 bp, Homo sapiens
  misc_feature: GZ8MTXP02JVUZ2.21.4.A04.1.454.CMB.2.raw
  modified_base (384)..(384): a, c, t, g, unknown or other
  modified_base (525)..(525): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggagggtcactgagtactctcctagtcgcacgtcctctgctacttccaccttcacgtcgaccacaaacagtggaccgtcgggccgacgaggcctacggaaggggaggggctgggaggtcgggtccggaccgtaagttaacccgaaagggaanaccgtaacgtagttaacgagtacgagtaaacgtcggctacgtcgagtaagaaaggtaagttcaacgtatcgtaacgaaagtcgatagtaacttaacgaaaactaaacgtcaagttcgtatctacgaataaacgtcgaaacncgaacgtaaacggaaacccgaaggacctacgggtacctaggtattaggtagtagtaacgaagtaaaagtggtagtagttacggtgggacgttcgagtcg

SEQ ID NO: 361586 - DNA, 755 bp, Homo sapiens
  misc_feature: GZ8MTXP02HNL88.21.4.A04.1.454.CMB.2.raw
  modified_base (289)..(289): a, c, t, g, unknown or other
  modified_base (567)..(567): a, c, t, g, unknown or other
tcagtcgtcgctcgcacgaccggtgctcgatttagagtagtgatcaggggagctctgagagcggagccccagccccagaattcccaggtgttttcatttggtgatcggcactgaacacagaggactcaccatggagtttgggctgagtcgttgggttttccttgttgttattttacgaaggtgtccagtgtgaggtgcagcgtgggtggagtcggtgggggagtacgttggtccaggccgtgggacgggtccctaggacgtaccttcctccgtgtcgcacgtcccttcncgactacttcctaccttcgaagtacgaaccaactaaacagtcggacgtcgggcccgtaccgaggtccgtaccggaagggggaacggggtcgtaggggtaacgggtcggggtaccggtacgttaacgtaaacgaaaggtaaaccgactaaacgtagttaaacgagtaacaagacgtcgggacgtcgtagtacggtaagaaaaggtacgttacaactacgtcaacgaaagtacgagtagtaattaaaccgaaagtacctctaacgttataacgtactaanaaacgttaaagtaccgaaaccctacggtaaaccccgaaaacggaaaaccgggaacggtacccggtaaacggtaccgtttaaggttaacgtttaggttacggttaaagggtaaacgaaaacgtaaaaggttcggtaagggtaacgttagggggttaggtacgggtagttccggacggtttaacgaaccg

SEQ ID NO: 361587 - DNA, 644 bp, Homo sapiens
  misc_feature: GZ8MTXP02JZ7JF.21.4.A04.1.454.CMB.2.raw
  modified_base (412)..(412): a, c, t, g, unknown or other
  modified_base (498)..(498): a, c, t, g, unknown or other
  modified_base (583)..(583): a, c, t, g, unknown or other
  modified_base (613)..(613): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagtacgttgggtccagccgtggacgggtcccgtgacgactctcctgtcgcaggcctctgcattccaccttcagtcgaccaacaacagtggaccgtgggtcccgccgtaggcctcccggaggggaacggggctgggaggtgggtccgccgtaagtacgaaggaacgctaacgagttacagtacagtaacgtacggaccgngtactgggtaacgaaaagggtaacggtttccaaccctatacgtacaaaaggtcgaattagaactttaaccgaaaacgttaaccctnaaccgttaggtactcgtacgaacctaaaatcgaaaacgaccggaacctaaggaaaaccccgtggaacccgtacggcgtagtttanagttacgtaggtaaacgaaacgtaaaaggngtaaggtagtggtacggttgacgcttcgaag

SEQ ID NO: 361588 - DNA, 605 bp, Homo sapiens
  misc_feature: GZ8MTXP02HFAYA.21.4.A04.1.454.CMB.2.raw
  modified_base (215)..(215): a, c, t, g, unknown or other
  modified_base (264)..(264): a, c, t, g, unknown or other
  modified_base (309)..(309): a, c, t, g, unknown or other
  modified_base (444)..(444): a, c, t, g, unknown or other
  modified_base (450)..(450): a, c, t, g, unknown or other
  modified_base (487)..(487): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacgttggtccagcctgggagggtccctgagtactctcctgtgcagcctntgctattcaccttcagtcgacccaacaacatggactcggggtccncaggctaccgaggggaaggggctgggagtcgggtacggccgtaattacgaaaggaaagctaaaacaggttacaaggttacaggaaatacggcgacgtctaggtagaaaacgggaaggttcaaccaattccgtaanaaaganaatgaattacaaaagaacttacaacttagtattacgngacaaaatgaaaccagacctaaggaaaaccgagaacgaacggcccgtaggtaatttagtagttaggaacgaaacgaaaaagtagtggtaaagtggtaggttacgaggtacgtagtacg

SEQ ID NO: 361589 - DNA, 712 bp, Homo sapiens
  misc_feature: GZ8MTXP02IVWZD.21.4.A04.1.454.CMB.2.raw
  modified_base (272)..(272): a, c, t, g, unknown or other
  modified_base (494)..(494): a, c, t, g, unknown or other
  modified_base (501)..(501): a, c, t, g, unknown or other
  modified_base (514)..(514): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagtcttgggttttccttgttgtttattttacaaggtgtccaggtgtgaggtgcagcgtggtggagtcgtgggggatacttggtccagccgtgggacggtccctgagtacctcctcctgtgcagccctntcgctacttccgaccttcagtacgaacccacaaactcgtggaccgtcggggtcccaccgacgggcccgtaccggaagggggtacggggcgtggggacggttcggggtaccgtaccgtaagttaacgaaagggtaaacgactaaacgtacgtaacacggtaacagggaacgtaccggaccggtcgttcgtagggtaagggaaacgggttaacgttccaaactntacgtanaaaggtatagtanacttaaacgaaaacgtactacgtaagttcgttaacgtcgtacgaaactaaaagtacccgaaagaccggtaacccgaaaacggaaaccggacgacggaccggttaacgttgttaaacgttggtttaggaaaggttacaaaaacggtaaggtaggtaagggttatccgggttaggggtaccgtacgtggtacgtaaacgg

SEQ ID NO: 361590 - DNA, 726 bp, Homo sapiens
  misc_feature: GZ8MTXP02F8M5I.21.4.A04.1.454.CMB.2.raw
  modified_base (200)..(200): a, c, t, g, unknown or other
  modified_base (293)..(293): a, c, t, g, unknown or other
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctccgaggggaaancgccaccctctcctgcagctccagccagaatatccagacgctactacatagcctggtaccagcagaagcctggccaggcctcccgaggttccnatctagtgccgtcggtccccacgacgggcccacgtcggccacgtccccgagtaccacggttccaggtcggccgtagggttcgggtctgggggaccaggtaccttcgaccttcgtactattactacgtttacgacgtaacggtacgttagggacgtaccgtaaggtaaacgttacgtttaccgacgttaaggttacgtttaaacgtttacggttacgttaccgtacgggtacgttaacggttaaaggtttacggggttaaacctttacccggttacccttacgtttccgggggtttaccggtttaaccggggaaccccggttaaaacgggggtaacccggttaaaagggttaacggtaaaacgttaacgggaaaaccgtaacggttaacggttacggtacgttacggaccttaaccgtaacgtttccgtttacg

SEQ ID NO: 361591 - DNA, 783 bp, Homo sapiens
  misc_feature: GZ8MTXP02IQBY3.21.4.A04.1.454.CMB.2.raw
  modified_base (217)..(217): a, c, t, g, unknown or other
  modified_base (266)..(266): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacttggtccagcctgggacgggtccctgagactctcctgtgcagccctntgcattccaccttcagtcgaacccacaaacagtaggacgttcggggtcccgaccgaggccctccggaaggggaaacggggcgtgggaaggtcggggtaccggcgtaaacgttaacgaaaggaaacgactaaacgtagtttaacgaagttaacgagtaacgtacggccgacgtacgtgtaaaggaaagggtacgttacaaacccgtataccgtaacgaaaaggaggtaacttaaggtaaactttaaaccgaaaacggaaaacctttccaaactttacgggtaactttacggtaacgaaataaaaaccgttcggaaaacccgaacgttaaacccggaaaacggtaaaaaccgggaccggtaaaaccgggacccggttccccgggtttaaaagtttaaacgtttaaacggtttaagggggtaaaacgggttaaaaccgaaaaacggttaaaaaggtaggggtaacggtaaggtttaggggttaacggggtaggggtttactacggttttacggtaaccgg

SEQ ID NO: 361592 - DNA, 692 bp, Homo sapiens
  misc_feature: GZ8MTXP02G2NUS.21.4.A04.1.454.CMB.2.raw
  modified_base (319)..(319): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggaggtcgtgggggagacgttggtccagccgtgggtacgggtccctggacgactctccgtgtgcagccctctgctatctacctcagtcaaccacaacagtcgggactggggtccccncgaggccgtacggaggggaggggctggggaggtcggggtacgtccgtaagtaacgaaaggaacgtactaaacgtagttacgaaagttacgagtaaacgtacgggcgacgttacgtaggaaacgggtaaaagggtaacgttccaacctaactcgtaacgaaagtaagtactagtaacgttaaacgaaaacgtacctaaacctattagttaacttatacggaaactaaagaaccgtaaacgacgtaacccgtaaaacgaaaaccggaacggtaacgaacggggtacccgttaagttaagtttaagtttaggtaagggttaaaacgaaaacgaaaaggtggtaaggtagttggtagggtggtaagtcggtagtacg

SEQ ID NO: 361593 - DNA, 756 bp, Homo sapiens
  misc_feature: GZ8MTXP02I4T0H.21.4.A04.1.454.CMB.2.raw
  modified_base (268)..(268): a, c, t, g, unknown or other
  modified_base (314)..(314): a, c, t, g, unknown or other
  modified_base (717)..(717): a, c, t, g, unknown or other
tcagtcgtcgctcgcacgaccggtgctcgatttagagtagtgatcaggggagctctgagagcggagccccagccccagaattcccaggtgttttcatttggtgatcagcacctgaacacagaggactcaccatggagtttgggctgagctgggttttccttgttgttattttacaaggtgtccagtgtgaggtgcagctggtggagtcgtgggggagacgttggtccagccgtgggacgggtccctgacgactctcctgtgcagcctntgcattcaccttcagtcgaccaacaacgatcggactcggggtcccncgacggctaccggaggggaacggggctagggacgggtcggggtacgggtacccgttagttaaacgaaacggggtaaaacgtccgtaaaacgacggtttaaaccaaggtaaacctaaggggtaaaacgtaaccggggtaccggtaccggttacgttaggggttaaaaggggaaaaaccggggttaaacggggtttaccgaaaccctaaacgtttaccgtaaacggaaaaggtaaggtaaaccgttaggtaaaagtttaaaccgaaaaacggtaactacctaacgtttaaggtacttacctagaaactaaagttaccaaacgtacgtaaccgtaaacggaaaaccgggacgacgaacggtctaggtttactttagttacggtacgggtaacaaacggtaaaaggnggttaagaagtggggttacgggagttacgtcgtagtacg

SEQ ID NO: 361594 - DNA, 705 bp, Homo sapiens
  misc_feature: GZ8MTXP02JVMLK.21.4.A04.1.454.CMB.2.raw
  modified_base (279)..(279): a, c, t, g, unknown or other
  modified_base (302)..(302): a, c, t, g, unknown or other
  modified_base (306)..(306): a, c, t, g, unknown or other
  modified_base (320)..(320): a, c, t, g, unknown or other
  modified_base (346)..(346): a, c, t, g, unknown or other
  modified_base (375)..(375): a, c, t, g, unknown or other
  modified_base (506)..(506): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggtttccttgttgttattttacaaggtgtccagtgtgaggtgcagcgtggtggaggtcgtgggggagtacttggtccaggcccgtgggacgggtcccctggacgtaccgtctccgtgtcgcagccctntgctattcaccttcagtcaccanaacntggactgggtcccncgaggtctcgaggggagggctagggngtcgggtcgacgtagtaagaacggtaaanctaagtagttacaagtacagaagtcgggcgtgtcaggtaagaaaagggtacgttacaacccgatcctaagaaacggagtatagtaaactttaacaaaaacgtaactaccgaacgttagttaactcgtaaanaaccgtaaaaattcggaaaacccgtagtaacccccggtaaaaggaaaaacccggtacggggtaaacccgtaaccggggtaccggtttaagttaaagtttacgggtagggttagggttaaaacggggaaaccgttaaaaaggggtcggtaaaggtgggttaaccgggtggggtaaacggttcgtcggttaagtaacccgg

SEQ ID NO: 361595 - DNA, 673 bp, Homo sapiens
  misc_feature: GZ8MTXP02JQS33.21.4.A04.1.454.CMB.2.raw
  modified_base (316)..(316): a, c, t, g, unknown or other
  modified_base (364)..(364): a, c, t, g, unknown or other
  modified_base (369)..(369): a, c, t, g, unknown or other
  modified_base (532)..(532): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtggggggagacgttgggtcccaggccctggggacgggtcccctggacgactctcctggtgcagcctctgcattccacttcagtgaccacaacatggactgggtccncgagctccgaggggaaggcgtggagtgggtcgcgtattacgaaggaanctaanagttacagttacagaatacggcgcgtagtggtaggaaagggtacgttcaaccctatacgtacaaaggtagagtaggtaaacttacggaaaaacgtactaactacttaggtattccgtaggaactaaaatacggaaacacggtacccgtaaaggaaaaacccgnggggaaaccccaacggggtacccttaggttaacgtttaacgttacggggtacggttaaaacgaaaacggtaaaaaggtggggttaaaggtagtttacggggtagggggttagggtaaaccggtccgttaggttaaacccgg

SEQ ID NO: 361596 - DNA, 633 bp, Homo sapiens
  misc_feature: GZ8MTXP02F4TNM.21.4.A04.1.454.CMB.2.raw
  modified_base (214)..(214): a, c, t, g, unknown or other
  modified_base (261)..(261): a, c, t, g, unknown or other
  modified_base (280)..(280): a, c, t, g, unknown or other
  modified_base (299)..(299): a, c, t, g, unknown or other
  modified_base (321)..(321): a, c, t, g, unknown or other
  modified_base (348)..(348): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgagtgcagctggtggagtctggggganacttggtccagccgtggagggtccctgagactctcctgtgcagcctntgcatcactcagtgaccanaacatggactggggtcccncgagctacggagggaggctggnggtcggcgtacgtaatacgaacgaacnctaaagtacgtacagtaacgagtactacgggcgtacgtcgtaggtaagaaaagggtacgtccaaaccgtatacaagaaagtatacgtagtaacttaacgaaaataactacgtacgtacgtacgtactacgtaactaaacgtaacgtaacgaacgtaaccgtaacgtaaaccggaacggaacgtaacggtacggtacggttaacgttaacgttacggttaacggtaacgtaaacgtaaaggtaaggtaaggtacgtacggtacggtaggtacggtacgtacgtacg

SEQ ID NO: 361597 - DNA, 573 bp, Homo sapiens
  misc_feature: GZ8MTXP02FEG4U.21.4.A04.1.454.CMB.2.raw
  modified_base (217)..(217): a, c, t, g, unknown or other
  modified_base (427)..(427): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggagggtccctgacgactctcctgtcgcagcctctgcattcaccttcagtgacccaacaacatggactggggtcccgccaggctaccgaggggaaggggctgggaggtggggtcgcgtattacaaggaaagctaaacagttacagtacagaatacggcgcgtctgtagaaaaggaagttcaaccatctcaaaganatagaattcaaaaagtaacctacactagtatctgaaccaaaatgaaaacaggacctaggaaaaacccgaggtaaccacggaccgtagttaatttaatggttagtaacgaacgaaaagtagtggaatggtggtcggtagcgtgtacg

SEQ ID NO: 361598 - DNA, 701 bp, Homo sapiens
  misc_feature: GZ8MTXP02FXWBW.21.4.A04.1.454.CMB.2.raw
  modified_base (322)..(322): a, c, t, g, unknown or other
  modified_base (394)..(394): a, c, t, g, unknown or other
  modified_base (401)..(401): a, c, t, g, unknown or other
  modified_base (421)..(421): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggttccctgagactctcctgtgcagcctctgctattccaccttcaggtacaacccaacaaacagtcgggtactcgggggtacccnccgaggcctaccggaaggggaacggggtctggggaggttcggggtccggaccgtaagttacgaaaggaaacncctaaanaagtttaaccagttaaacgnggaaactaccggggcgtacgtcgtagggttaacgggaaaagggttaaacgggttcaaaccctataccgtagaaagagattaggtaatacaaaacgtactacctaagtagttaactccgttaaagaaactaaacgtacgaaacgtacggtaaccgaaacgggaaaaccggacggtaaccgtacggtaacgtttaagttaagtttacggttaggttaaacggtaaacgaaaacgtaaaggtaaggtaaggtaagtgggtagggtacggtagtcgtacgtacg

SEQ ID NO: 361599 - DNA, 775 bp, Homo sapiens
  misc_feature: GZ8MTXP02HUS06.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctggagtcgttgggtttttccttggttttgtttattttacgtaaggttgtccagtgtggaggtgcagcgtggtggagtcggtgggggagtacgttcggtccgaggccgtggggacggtcccgtggacgtactcctccgtgtcgctacgtcctctcgctacttcccaaccttcgtagtacgaaccccaaacaacgtaggtacggtaccggtccggggtaccccgacccgaccgggtaccgtacccggaagggggaacggggcgggttacggggtggggttacggggtaccgggtaccgttaacgttaaacggaaaacggtaaaacgtacctaaagtaacgtttaacgacggttaacaggaaacggttacggccggtacgtacgttagaaagggtaaaacgggtacgttacccaaactatacctaacggaaagagtataacgaatttaaaccgaaagtaacctaatccgttaaagtaccttagacgtaaaactaagtacgaaaaccctcggaaacgtaaacggaaaccggtacggaacgtaaccggtcgttaagttatttaacgtggttaaagggaaaacgaacgtaaaaggtacggtaagtagggtacgtaggggtatacggcgttagtaaccg

SEQ ID NO: 361600 - DNA, 666 bp, Homo sapiens
  misc_feature: GZ8MTXP02FHU50.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagccgtgggacgggtccctgagactctcctgtgcagcctctgcattcaccttcagtcgaccacaacatggactgggtccgcgaggctccgaggggaagggctggaggtgggtcggccgtattaacgaacggaaagtctaaacgagttaacagttaacagaaactacgggcgtacgtctaggtacggaaaagggtaaggttaccaaccgtaatctaacgaaagaaggtaataggtaacttacgaaaaacgtaaccttacaacgttagttaactcctagaacctaaaagtacgaaaactacggacccgtaaacggaaaaacccggaggaacccgtaacgggaccgttagtttaaagtttacgtttacgggtaaggtaacgaaaaccgaaaaaggtaggtaaggtaaacgttgggttacgggtaggttagacgtttcggaacg

SEQ ID NO: 361601 - DNA, 729 bp, Homo sapiens
  misc_feature: GZ8MTXP02J0XNR.21.4.A04.1.454.CMB.2.raw
  modified_base (178)..(178): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtntccagtgtggaggtgcagcgtgggtggaggtcgtgggggagtacgttggtccagccgtgggacgggtccctgacgactctcctgtgcagtcctctgctattccacccttcaggtcaacccaacaacgagtcgggactcggggtcccgaccgaggccctcgggaagggggacggggcgtggggacggtcggggtccggaccgttaagttaacgaaaggtaacaccgtaaacgtagttaacgagttaacgaggtaaactaccggggcgcgttacgtaaggtaaagggtaaaacgggaacgggtttaccaaacccgtacgtaccgtaacgaaagtaacggtactaggtaacttaaacgaaaacgtaattaccaaaccgtttaggtacttcgtacgtaaactaaaagttcgaaactacggtaacccgtaaaggaaaacccggtaacgggaccgtaacgggtacccggttaagttaacgttaggttacggtaagggtaacgaaaacgtaaaagtaggtaaggtagtacggtcggttaggtacggtcgtaggtaacg

SEQ ID NO: 361602 - DNA, 587 bp, Homo sapiens
  misc_feature: GZ8MTXP02JIV7H.21.4.A04.1.454.CMB.2.raw
  modified_base (202)..(202): a, c, t, g, unknown or other
  modified_base (290)..(290): a, c, t, g, unknown or other
  modified_base (415)..(415): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccacctctcctgcagctccagccagaatactccagagctactacatagcctggtaccagcagaagcctggccaggctccaggtccnatctatcgctgggtcccagacgggcccacgtcggcaactcccgaagacctaggttccaggtgctaggtcgggtcgtgggggacagtaccgttcactctacgatctaattagctagacctaggacncgtagaagtattcgactagtgttaattacgtgtaccgagacgtaagtatacggtaaacgttctaaccgttcgtacgtcggttaccggaccgaaaggggtaacccaaaggtaagtaaaacgtaacggaaacgtaacgtgtacggaccgtaggacctaaaccgtattcggttag

SEQ ID NO: 361603 - DNA, 710 bp, Homo sapiens
  misc_feature: GZ8MTXP02HVEC9.21.4.A04.1.454.CMB.2.raw
  modified_base (327)..(327): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttacaaggtgtccagtgtgaggtgcagcgtggtggagtcgtgggggagtacgttggtccagccgtgggacgggtccctgacgactctcctgtcgcagtccctcgtgctacttccaccttcagtacgacccaacaactagtcggacgtcggggtccnccgaggccgtaccggaagggggaaggggcgtgggtagggtcggggtaccggtaccgttaagttaaccggaaaagggaaacgtaccgtaaacgtaacgtttaacgaacgttaacgaggtaaacgtacggggcgtcgttacgtaggtaaaggaaaacgggtacgttaccaaaccgtaattcgaacgtaaagagtagtagtaaacttaacgaaaagtaacctcgtaattagtatacctagtaaacaaagtacgaacgaacgtaaccccgtaaaggaaaaaccccggagaacccgtacgggtcttagttactttacgtaggtaacgtaaacgaaaacgtaaaagtggtaaggtaagttgggtacgggttagtaacgtgttacggacg

SEQ ID NO: 361604 - DNA, 739 bp, Homo sapiens
  misc_feature: GZ8MTXP02J106I.21.4.A04.1.454.CMB.2.raw
  modified_base (179)..(179): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtntccagtgtgaggtgcagctggtggagtcgtgggggatacgttggtccaggccgtgggacgggtccctgacgactctcctgtgcagcctctgccattccaccttcagtcgaccacaacatgggactcggggtccaccgaggctccggaggggaacggggcttaggggaggttcggggtaccggtaccgtaagttaaaccggaaagggaaaacgtccgttaaaacctaaggtttaaccgaacggtttaacgacgggtaaacttaaccgggggccgtcggttaccgttagggttaaagggaaaacggggtaaacgggtttaccgaaacccgtaacttacccgttaacgaaacgacggttaacttaggtaaactttaaccgaaaaacgtaacctacgtaaccgttaggtaactactagtaacaaaacgtacgaaacgtaacgacccgtaaacgaaacccggaacggtaaccgaacgggtccggtaagtacgttacgttacggtacggtaaacgaacgtaaaaaggaggtaagtagtcggtacgttgggtaagtccgttaggtcg

SEQ ID NO: 361605 - DNA, 724 bp, Homo sapiens
  misc_feature: GZ8MTXP02JYL7X.21.4.A04.1.454.CMB.2.raw
  modified_base (302)..(302): a, c, t, g, unknown or other
  modified_base (350)..(350): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctggagggtccctgagactctcctgtgcagcctctgcattcaccttcagtgaccacaacatggactgggtccncgaggctccgaggggagggctggagtgggcgtccgtatacaaggaacnctaacagttacagtaacagaactcggacgtgtctaggtagaaaaggtaacgggttacaaccgtataccgtacaaaggtagagtagaactttaacaaaagtaacctacaaccgttagttaaactccgttagaactaaaacgttacgaaaaccgtacggttaaccctaaacggggaaaaaaccccgggtaacgggaaaaccgaacccgggggttacccggttaaagggttttaaacgttttaaacgggttttaggggttaaacggggttaaaaggtaaaacccggaaaaaaaaggggttcgggttaaaggggtaaaggtttcgggggttaccgggggtttaggggttaaaaccggtcggtttagggttaaacccgg

SEQ ID NO: 361606 - DNA, 657 bp, Homo sapiens
  misc_feature: GZ8MTXP02IZKT4.21.4.A04.1.454.CMB.2.raw
  modified_base (275)..(275): a, c, t, g, unknown or other
  modified_base (277)..(277): a, c, t, g, unknown or other
  modified_base (453)..(453): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttacaaggtgtcagtgtgaggtgcagctgggtgggaggtcgtgggggagacgtttgggtccagcccgtgggacgggtccctgagactcctcctgtgcagccctntncattcaccttcagtcgaaccacaacatcggactcggggtccgcgaggctccggaggggaaggggctgggaggttcggggcggtaccgtaagttaacgaaaggaaacgctaaacgagtttacgagtaacagatacggcgtcgtctaggtagaaaggtacggttcaaccgtatcgtanaaagagattaggaattaacgaaaacgtacctagaccttaggtacttactagaaacaaaatcggaaaacacgtaccgaaaagaaaaccggaggaaactaccgggtacgttaggtaatttacggtaggttaacggtaacgaaaaacgaaaagggtaggttaaggagttagggttaccgggggtagtaaacgggtctaggtttaacg

SEQ ID NO: 361607 - DNA, 697 bp, Homo sapiens
  misc_feature: GZ8MTXP02HKNW5.21.4.A04.1.454.CMB.2.raw
  modified_base (554)..(554): a, c, t, g, unknown or other
  modified_base (630)..(630): a, c, t, g, unknown or other
  modified_base (671)..(671): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaagactcaccatgggtagtttgggctgagtcgttgggttttccttgtttgttattttacaaggtgtccagtgtgaggtgcagcgtggtggagtcgtgggggatacgttggtccaggtccgtgggacgggtccctaggagtaccttctccgtgtacgccacgcctctgctacttcctaccttcgacgtacgaaccaactaacgtacgtacgggtaccgtcggggtaccccgaccgtacgggacccgttaccggaaaggggggaacggggtccgttagggggtacgggttcgggggtaccggtaccggtaaagttaacggaaacgggtaaacgtactaaacgtagttacgaagtacgagtaacgtacggccgtgtcgtaggaaacgtaaagggtacgtacaacctagtacctagaagatagtaagacttaacgaanacgtacaattcgtattcgacgaataacgacgtaacacgacgtaaacggaacgaacgaccgacgggtacgtagtttntagtagggtacgtaagaaacgttaaggacggtaaggttagngggttagggagttagcgtacggttac

SEQ ID NO: 361608 - DNA, 710 bp, Homo sapiens
  misc_feature: GZ8MTXP02JRRZP.21.4.A04.1.454.CMB.2.raw
  modified_base (217)..(217): a, c, t, g, unknown or other
  modified_base (279)..(279): a, c, t, g, unknown or other
  modified_base (289)..(289): a, c, t, g, unknown or other
  modified_base (312)..(312): a, c, t, g, unknown or other
  modified_base (560)..(560): a, c, t, g, unknown or other
  modified_base (601)..(601): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttgggtccagcctgggacgggtccctgagtctctcctgtgcagcctctgcattcaccttnagtcgaccanaacagtgggacctggggtccccnccgaggcctacccggagggggaacggggtccttaggggacggttcgggggtccggtaccgttaagttaaccgaaaaggggaaacgtacctaaaacgaagtttacaacggttacaagggtaaacgtaccggggccgaccgttgtacggtaaggaaaacggggtaaacggtttccaaacccgtattacctaacgaaaggaatagtagtaatttaaccaaaagaaccttacgactttagtacttacggtanaactaaaagtcgaaaacacggtaccctaaaggaaaacccgngggtaaccaaccggggttccgttattaagtttaagttgggtaaacggtaacgtaaaacgaaaaggtggtaaggtaagttcgggttaggggtaggtaggctttaggaacg

SEQ ID NO: 361609 - DNA, 820 bp, Homo sapiens
  misc_feature: GZ8MTXP02FK3E0.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcagcgtggtggaggtcggtgggggagtacgttggtcccagtccgtgggacgggtccctggacgtaccttcctcccgtgtcgcacgccctctgctattcctaccttcagtcgaacccaacaacagtcggaccgtcggggtccccaccgaggtccgtaccggaagggggaacggggcgtggggacgggttcggggtaccggtaccgttaaagttaaaccgaaaagggaaaacgtacctaaaacgtaggtttaaaccaaggttaaacgagggtaaaccgtaccggggtacgtaccgttacgttaagggtaaacgggaaaaaggggttaaacgggtttacccaaacccgttaagttacccgtaaacgaaaagggtaagtaagttaacggtaaaactttaaaccgaaaaaaacgtacccttaacgtaaaccgttaggttaactacgtacgtaaaaacaaaacgttacgaaaacccgacggtaaaccccgaaaacgggaaaaacccggaggtaaaaccccggaccgggttaccgttaggtttaaactttaggttaaggttaacgggtaaaagaaaacgtaaaggtaggtaaggttagtgggttagggttacggtagtcggtaggttaaacg

SEQ ID NO: 361610 - DNA, 769 bp, Homo sapiens
  misc_feature: GZ8MTXP02FGI83.21.4.A04.1.454.CMB.2.raw
  modified_base (218)..(218): a, c, t, g, unknown or other
  modified_base (315)..(315): a, c, t, g, unknown or other
  modified_base (379)..(379): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttacaaggtgtccagtgtgaggtgcagctggtggagtcgtggggganacgttggtcccagccgtgggacgggtccctgacgactctcctgtgcagcctctagctatcaccttcagtcgaccaacacagtcggacgtggggcccnccgaggcctaccggaggggagggctgggaggtcggggtcggaccttaagtacaaaggggaaacnctaaagagttacgagtaacagaacgtacgggcgtaccgtatagggaagaaaagggtacgttaccaaccgtattacctacgaaaagtagaagtaggtaaactttaacgaaaaaacgtacccttacgtaaaccgttaggttaacttaccgttaaggaaaaccctaaaaagttaccggaaaaaccaaccggtaacccgttaaaaccgggggaaaaaaacccggacggggtttaaaacccggaaaccccgggggttacgtttagggttaaatttaacgggttagggttaaccggggtaaaagttaaaaacccggaaaaggggtaggttaaccggggtaaagttcggggtttaagggggtttgggtttaaaccggtttggacccgtttaaaacgg

SEQ ID NO: 361611 - DNA, 802 bp, Homo sapiens
  misc_feature: GZ8MTXP02H7HXY.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtgcagcctctgctacttcctaccttcagtacgaacctaacaaccgagtggaccgtcggggtcccgccgacggcctaccggaagggggaacggggcgtggggacgggttcggggtaccggtacccgttaaagttaaccggaaacgggtaaacgtaccgttaaaacgaacggtttaacaacggttaaccagggtaaaacgttaccggggaccggtacgttcgtaggtaaacgggtaaaaggtaaccggggttaccaaacccgtaagtttccctaaacggaaaagtaagtacgttaggtaaactttaaacccgaaaagtaacccttaactaacgtttaaggtacttacgttaacggaaaccttaaaagtacggaaaaccacggtaacccgtaaaacggaaaaacccgggaacggtaacccggaaacccggggttccgttaaaggtttaacttttaaggtacggggttaaaggttaaacggaaaacgtaaaagggtaggttaagggaagtttacggggtaggggttagtacggtacgttacggtaaccgg

SEQ ID NO: 361612 - DNA, 669 bp, Homo sapiens
  misc_feature: GZ8MTXP02HLT0K.21.4.A04.1.454.CMB.2.raw
  modified_base (265)..(265): a, c, t, g, unknown or other
  modified_base (307)..(307): a, c, t, g, unknown or other
  modified_base (610)..(610): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggatacttggtccaggcctgggacgggtccctgagactctcctgtgcagcctntgctatcaccttcagtgaccacaacagtggactggggtcccnccgaggcctccgaggggaagggctgggagtcggggcggccgtaagtacgaacgggtaaacgctaaacagttacaggtaacaggaacttaaccggggcgtacgtcgtagggtaaacggaaaaggggtaaacggttccaaacccgtagtacccgttaacgaaaaggtagtaataggtaaactttaaccgaaaagtaaccttcgaacttaggacttctaggacctaaaagtcgaaacacggtaactaacggaaaaccgtggtaaccgacgggtccgttagttacgtttacttgggtaacggtaaanaaacggtaaaaaggtggtaagtaagtggggttacgggtaggtaacgtcggtagtaaccg

SEQ ID NO: 361613 - DNA, 678 bp, Homo sapiens
  misc_feature: GZ8MTXP02I34ZL.21.4.A04.1.454.CMB.2.raw
  modified_base (178)..(178): a, c, t, g, unknown or other
  modified_base (215)..(215): a, c, t, g, unknown or other
  modified_base (505)..(505): a, c, t, g, unknown or other
  modified_base (645)..(645): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgctgttattttacaaggtntccagtgtgaggtgcagctggtggagtcgtggggganacttggtcccagcccgtgggacgggttcccctggacgacctctccgttgtcgctacgcccttctggcctattccaccttcaggtcgaacccacaactagtggaccgtgggtcccgccgaggcctacccggaaggggaacggggtcctaggggacgttcgggggtaccggaccggttaagttaaccccgaaaagggaaacgtccttaaaacgtagtttaaaccgaggtaccgagtaaacgtcgggaccgtcgttcagggtacgaaaagggtaggttaccaacgatccgtanaaaggtagtaatacgaattacgaaagtaacctacgtaaccttaggtatccgtagaactaaagtaggaacaacgaacctaggaaaaccgagaacgaccggcgttagtaacttagttaggtaggtaaacgtaacgaaaaggngttaggagttaggtggtacggtagtacgttagg

SEQ ID NO: 361614 - DNA, 761 bp, Homo sapiens
  misc_feature: GZ8MTXP02FVGGC.21.4.A04.1.454.CMB.2.raw
  modified_base (216)..(216): a, c, t, g, unknown or other
  modified_base (267)..(267): a, c, t, g, unknown or other
  modified_base (311)..(311): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtggggganacgttggtccagccgtgggacgggtccctgagactctcctgtcgcagcctntgctattcaccttcagtcgaccacaacagtggacgtggggtccnccgaggcctaccggaggggaaggggctgggaggtcgggtccggacgttaagtaacgaaagggtaaacgcgtaaaacgagttaacagttaacagaaactcgggcgtacgtcgtaggtaagaaaagggtacgttccaaacctagtcctaaacgaaagtagtattaggtaaacttaaccgaaaaaaaggtacccttacgaaacgtttaggttaacgtaccttaaggaaaacccgttaaaaattacccggaaaacgaccgtaaaccccgttaaaaacggggaaaaaaacccccggggagggtaaaccccggtaaccggggtttacggtttaagtttaaaacgtttaacgggtttaacggggaaaacggttaaaacggaaaaacggtaaaaggggttacgggtaaggttaaaggtttgggggtaccgggttaggtaacggttcgtaaggtacccg

SEQ ID NO: 361615 - DNA, 853 bp, Homo sapiens
  misc_feature: GZ8MTXP02JDWL9.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggaggtcgtgggggagtacgttggtccaggcccgtgggacgggtccctgacgtactcctcctgtgcacgcctctgcattccaccttcagtacgacccaacaactagtggtacgtcggggtaccccgccgacgggtcctaccgggaagggggaacggggtccgtaggggacgggttcggggtaccggtacccggttaaagttaaaccggaaaaggggtaaaacgtaccgtaaaaaccgtaaggtttaaccgaaacggttaacgaagggtaaacgttaaccggggccgtaccggttacgtagggtaaagggtaaaacggggtaaccgggtttccaaacccgttaagtacccgttaacgaaaaagggtacgtaaccgttaagtaaacgtttaaaccgaaaaaacggttacctaccgtaaacgttagttaacgttaccgtaagggtaaacctaaaaacggttcgaaaaaccgaccgggttaaacccgtaaaacggaaaaaccccggggtgggaaaacccgtaccgggttaccggtttatttaaaggtttacggtttaaagggaaaggttaaaccgaaaaaacggtaaaggttagggtaaccggttaagttacgggggttacgggtagggttaacgtccggtttagggtaaaccg

SEQ ID NO: 361616 - DNA, 756 bp, Homo sapiens
  misc_feature: GZ8MTXP02I2WOV.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgtttattttacaaggtgtccagtgtgaggtgcagcgtgggtggagtcgtgggggagtacgttggtccaggccgtgggacgggtccctggacgtacctctcctggtcgacagtcctctgacctattccaccttcgagtcgaaccccaacaacgtagtcgggtactccggggtacccaccgtacggtcccgtaccgggaagggggtaacggggtcgttggggaacggttcgggggtacccggtaccggttaaagttaaccggaaaaggggtaacctctaaaacgtaggtttaacaacggttaaccaggtaaacgtaaccgggacgtaccgttacgtaggtaaaggggtaaaaggtacggttacccaactacgttaccgaagaaagtaagtacgtagtaaacttaaccgaaaagtacctacgtaacttggttaacttcgtaagaactaaaacgacgaaacgtacgaccgtaaaacggaaaacccggtggaaacgtcccggtaacgtagttaacgttagtagggttaacgtaaacggaaaacaaaggtggtaagtacgggtaggttacgggtcgtaaagtcggtttcgaaacgg

SEQ ID NO: 361617 - DNA, 649 bp, Homo sapiens
  misc_feature: GZ8MTXP02FHWZP.21.4.A04.1.454.CMB.2.raw
  modified_base (467)..(467): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtcccagccgtgggacgggtccctgagactctcctgtgcagcctctgcattcaccttcagtcgaccacaacagtggactgggtccgccaggcctccgaggggaagggctgggaggtcgggtccggcgtagttacgaaaggaaacgctaaacgtaggttaaccagttaacaggaaactacgggcgtaccgtcgttaggtaacgggaaaagggtaacgggtttcaaacccgtatctaacgaaaganatagtaattacaaaaagtactacaacgttagtactactagaacaaaagtgaaacagaacccgtaagaaaaccccggagaaacccgacgggtaccgttagtacgtttagttacggtagggtaaacgtaaaacgaaaaggtagtaagggtaattcggtagggtaggtaacgtcgtaggtaacgg

SEQ ID NO: 361618 - DNA, 685 bp, Homo sapiens
  misc_feature: GZ8MTXP02FK973.21.4.A04.1.454.CMB.2.raw
  modified_base (281)..(281): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttggtccaggccgtgggacgggtccctgagacctctcctgtgcagcctctgcattccaccttnagtcgaaccacaaacagtcggacgtcggggtcccgaccgaggcctacccggaagggggaacggggccgtaggggacggttcgggggtccggtaccgttaagttaaaccgaaagggaaaacgtcctaaacgagttaaccaagtaccaagtacgtccgggcgtcgttactagtaaggaaagggtacggttaccactatcgtacaagagtagagtattaacgaaagtaacctctaactgtatctagaactaaagtacgaactacgaccgtaacggaaaaccggacggaaccgaaccggtacgttagttaagtttagtttaggtaaggtaaacggtaaaacgtaaaaaggtgggtaaggtaagttgggttacggggttaggtaaccgtcggtaggttacggtaaaccg

SEQ ID NO: 361619 - DNA, 621 bp, Homo sapiens
  misc_feature: GZ8MTXP02F9PYE.21.4.A04.1.454.CMB.2.raw
  modified_base (264)..(264): a, c, t, g, unknown or other
  modified_base (304)..(304): a, c, t, g, unknown or other
  modified_base (357)..(357): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgttcagtgtgaggtgcagctggtggagtcgtgggggagacgttggtccagccgtggagggtccctgagctctcctgtgcagcctntgcattcaccttcagtgaccacaacatggactggggtccnccaggcctccgaggggagggctggagtgggtcgcgtatacgaaggaagctaanagttacagtaacagaactacggcgtcgtctaggtagaaagggaacgttccacctatcgtacgaaagtagatagaattacaaaagactacaactgtaatcgtagacctaaaatacgaaactacgaccgttaaacgaaaaccggtaggaccaaccgggtaccgttaaggttaatttaacggttaggtaggttaaacggaaaccgtaaggtaaaacgggaagttaaggggaagtttggggtcggtacggtaaaggtccgtttaaggg

SEQ ID NO: 361620 - DNA, 573 bp, Homo sapiens
  misc_feature: GZ8MTXP02JF9SC.21.4.A04.1.454.CMB.2.raw
  modified_base (217)..(217): a, c, t, g, unknown or other
  modified_base (290)..(290): a, c, t, g, unknown or other
  modified_base (303)..(303): a, c, t, g, unknown or other
  modified_base (357)..(357): a, c, t, g, unknown or other
  modified_base (377)..(377): a, c, t, g, unknown or other
  modified_base (382)..(382): a, c, t, g, unknown or other
  modified_base (407)..(407): a, c, t, g, unknown or other
  modified_base (459)..(459): a, c, t, g, unknown or other
  modified_base (477)..(477): a, c, t, g, unknown or other
  modified_base (533)..(533): a, c, t, g, unknown or other
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctggggganacttggtccagcctgggagggtccctgagactctcctgtgcagcctctgcattcaccttcagtgaccacaacntggactgggtccncgaggctcgaggggagggctggagtgggtcgccgtattacgaaggaagctaaanagttacagtacagaatcggnacgtntgtaagaaggtagttcacgtatcanaagagatgacttagaaaagtactcaacttgtattccgagacaaatcgaaacngaccgtaagaaaacccgngggaacacgggtacttaggttaattacgtaggtaggtaaacgaaacgtaaaagggnggtaaggtacgttagggtacggtaggtcgacgttagtacg

SEQ ID NO: 361621 - DNA, 544 bp, Homo sapiens
  misc_feature: GZ8MTXP02FMXF5.21.4.A04.1.454.CMB.2.raw
  modified_base (204)..(204): a, c, t, g, unknown or other
  modified_base (214)..(214): a, c, t, g, unknown or other
  modified_base (275)..(275): a, c, t, g, unknown or other
  modified_base (295)..(295): a, c, t, g, unknown or other
  modified_base (314)..(314): a, c, t, g, unknown or other
  modified_base (355)..(355): a, c, t, g, unknown or other
tcagtcgtcgctcgcacgaccggtgctcgatttagagtagtgatcagggggaagagctgctcagttaggacccagagggaaccacggaaaccccagcgcagcttctcttcctcctgctactctggctcccaggctcagaaaaccaccggagaaattgtgttgacgcagtctccaggcaccctgtctttgtctccaaggggaaanagccaccctntcctgcagctccagccagaatatccagagctaactacatagcctggtaccagcagaagccnggccaggctcccaggttccncatctatgctgggtcccanagggccactggcatccagacaggttccagtggcagtggtcnggggcagacttcgactctcatcaatagcagactggagctgaagactttcgactagtagtattaactagtcgagactagtagtaggtaagttctaactctgtcgttacggccgaaaacgggaccaaaagggtaagtaaaaataggaaaaaccgtaacgtaaggtggcgtgacgaccaactacgtacttcg

SEQ ID NO: 361622 - DNA, 663 bp, Homo sapiens
  misc_feature: GZ8MTXP02FGZV3.21.4.A04.1.454.CMB.2.raw
  modified_base (216)..(216): a, c, t, g, unknown or other
  modified_base (265)..(265): a, c, t, g, unknown or other
  modified_base (280)..(280): a, c, t, g, unknown or other
  modified_base (317)..(317): a, c, t, g, unknown or other
  modified_base (537)..(537): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgacgactctcctgtgcagcctntgctattccaccttnagtcgaacccaactaacatgggacctgggggtccccnccgagggcctaccccggaagggggtaacggggcctggggacgggttcggggtccggccggttaattaacgaaacggggtaaacgcctaaacgaggtttaccaaggttaccagtaaacgtaccgggctacgttctaggggtagaaaaaggggtaacgtttaccaaacccgtatcctaacaaaggtagataggaattacaaaacgtacctcaatgtaactcncggtacaaagtcgaaaccgtagacctaaacggaaaaccgaggaccgaacgggtccctagttacttagtaggtaggtaacgaacgaaaaggagtgggtaatcggtagggtgtaacggcgttgtaacg

SEQ ID NO: 361623 - DNA, 568 bp, Homo sapiens
  misc_feature: GZ8MTXP02F5VS1.21.4.A04.1.454.CMB.2.raw
  modified_base (216)..(216): a, c, t, g, unknown or other
  modified_base (268)..(268): a, c, t, g, unknown or other
  modified_base (280)..(280): a, c, t, g, unknown or other
  modified_base (284)..(284): a, c, t, g, unknown or other
  modified_base (296)..(296): a, c, t, g, unknown or other
  modified_base (348)..(348): a, c, t, g, unknown or other
  modified_base (352)..(352): a, c, t, g, unknown or other
  modified_base (488)..(488): a, c, t, g, unknown or other
  modified_base (543)..(543): a, c, t, g, unknown or other
  modified_base (558)..(558): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagcgtggtggagtcgtggggganacttggtccagcctggacgggtccctgagctctcctgtgcagctctgcatcnctcagtcaccanaacntgactgggtccncaggctaccgagggacgggctggagtgggttcgctatacgaagaagctaaangtanaggtacagatacggcgcgtctaggtagaaaggtagtacaccgatatacgaagagagttagaattacaaaaagtacttacaccgttataactctagtaacaaagtacgaacacggacctaacgaaaaccgacggtanaccgggtactaggttacttaagtagtacggtaacgaaaacgaaagtagtaacggngtaggtggtacgtanacgtagtacg

SEQ ID NO: 361624 - DNA, 647 bp, Homo sapiens
  misc_feature: GZ8MTXP02JNOX1.21.4.A04.1.454.CMB.2.raw
  modified_base (421)..(421): a, c, t, g, unknown or other
  modified_base (633)..(633): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggaggtcgtgggggagtacgttggtccagccgtgggacgggtccctggagactctcctgtgcagcctctgctattcaccttcagtcaaccaacaacagtcggacgtcgggtcccaccgaggcctaccggaggggaacggggctggggaggtcggggtcggtaccgtaagtaacgaaaggtaaacgactaaactagttacagtaacagaaagttaccggngtaccgtagtaggaaacggtaaaagggtaacgttccaaacccgttataccgtaagaaagggtataagtagtaaacgttaaaccaaaagttaacctctaaacgttgtaactcgtagaactaaatacgaaacgacgtaccgaaaagaaacccggtaggaacgaccgtgtagttatagtagacggtaagaaaacgaagagtgacgttggtacggnggtactcgagtacg

SEQ ID NO: 361625 - DNA, 840 bp, Homo sapiens
  misc_feature: GZ8MTXP02HZKZM.21.4.A04.1.454.CMB.2.raw
  modified_base (274)..(274): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgtttgttattttacaaggtgtcagtgtgaggtgcagcgtggtggagtcgtgggggagtacgttggtccagccgttgggacgggtccctgacgactctccgtgtgccagcctngctacttcacttcagtcgaaccacaactagtcggaccgtcggggtcccgacgacggaccctccgggaaggggtaacggggcgtagggtacggtcggggtaccgaccgttaaagttaacgaaaacggaacgtacttaaacgagtttaacgagttaacgagtaacgacggtcgtccgttagtagggtaaagtaaacggtaacgtacgtaaccgtacgtacgtaacgaaagtaagtagttaacgtaaacgtttacgaaaaaaaaaaacggtccttaaaacgttaacgttaaacggttaacttaacgtaacgtaaacgtaaaacgttaaacgaaaccgtaaacggtaaccggttaaaaccggtaaaaccgggaaacggtaaacccggtaacccgggttaaacccgtttaagggtttaaaacgttttaaacggtttaacggggttaaacggttaaaaccgggtaaaaacgggtaaaaacgggttaaaggggtttaaacggggtaacggttttaacgggggttacggggttaacggggtttaacggtacgggtttaacggtttaaacccggg

SEQ ID NO: 361626 - DNA, 752 bp, Homo sapiens
  misc_feature: GZ8MTXP02HIH2U.21.4.A04.1.454.CMB.2.raw
  modified_base (282)..(282): a, c, t, g, unknown or other
  modified_base (315)..(315): a, c, t, g, unknown or other
  modified_base (717)..(717): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctggtggagtcgtgggggatacgttggtccaggcctgggacgggtccctgagctctcgtgtgcacgcctctgctacttccaccttnagtcaccaacaacagtcggacgttcggggcccncgaggccgtaccggaagggggaacgggtcgtaggggacggttcggggtacccggaccgtttaaagttaaaccggaaaaggggtaaaacgtaccgttaaaaacgaacggttttaaacgaacggttaaaccgaagggtaaaacggttaaccgggccggtaccggttacgtaggggtaaaaggtaaaaacggggttaacggttacccaaacccggtattacccgtaaacgaaaagggtaacgtaacgtaaggtaaactttaaaccgaaaacgtaaaccgttactaaccgttagttacttagtacgaaactaaaacgtagaaacgacgtaaccgtaaaggaaaaccccggaggaaaccgaccggtacgtagttagttacgttggaacggtaacgaaagtaaaaggnggtaacgtaagtcggtaggtagtagtcgttaggac

SEQ ID NO: 361627 - DNA, 606 bp, Homo sapiens
  misc_feature: GZ8MTXP02I7HH8.21.4.A04.1.454.CMB.2.raw
  modified_base (265)..(265): a, c, t, g, unknown or other
  modified_base (394)..(394): a, c, t, g, unknown or other
tcagtcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagttcgtgggggatacgttggtccaggcctgggagggtccctgagctctcctgtgcagcctntgcattcaccttcagtagacccaacaacatggactcgggtccgccaggtcctacggaggggaagggctgggagtcggggtacgacgttataacgaagaacgataccagtacagtaccagagtcggacgngtacgtagacgaaagggtacgtcgaacctatctacgaagagtatagaattacgaaaagtacacaaccgttgtaactcttaggaaccaaagtagaacacggtacctaaacggaaaaccgaggaacgtacggtacgttacgttagttaagttcggtaaaggttacgaaacgaaaagtggtagtaagtaggtgtacgggtatcggtagtacgtag

SEQ ID NO: 361628 - DNA, 784 bp, Homo sapiens
  misc_feature: GZ8MTXP02F818W.21.4.A04.1.454.CMB.2.raw
  modified_base (269)..(269): a, c, t, g, unknown or other
  modified_base (547)..(547): a, c, t, g, unknown or other
  modified_base (660)..(660): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagagactcaccatggagtttggctgagcttgggttttccttgttgttattttacaaggtatccagtgtgaggtgcagcgtggtggagtcgtgggggatacgttggtccaggtccgtgggacggtccctgacgactctctgtgcacgtcctntgctattccaccttcgagtcgaacccaacaactagtcggtaccggtcgggtaccccgccgaacgggtccctaccgggaagggggaaacggggtcgttaggggtacggggtttacggggtcccggtaccgtaaagttaacccgaaaaaggggaaactaccgtaaaacgtaacgttaacgaaacggttaaccagggaaactaccggggccgtacgttaccgtaagggtaaacgggtaaaaacgggtaacgggttaccctaaacccgaagttacccgtaanaaaagggtagaacttaggtaaacttaaccgaaaagttaactacctagtagtacctacgtagtaaacctaaaagtccgaaaacgtacgtaaacccggaaacgggaaaaacccgngggtaaacccgtaaccggttacgttaacgtttaagtttagtacggggttaacggtaaaagtaaaacctaaggggtagtaagggtattaggggtacggtagggtacgtaccgttagtaacccggg

SEQ ID NO: 361629 - DNA, 802 bp, Homo sapiens
  misc_feature: GZ8MTXP02FM3SM.21.4.A04.1.454.CMB.2.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctgggtggagtcgtgggggagtacttggtccagccgtgggacgggtcctgacgactctcctgtgcacgcctctgctattccaccttcagtcgaccaacaacagtcgggacgtcggggtcccgcgacggccgtaccgggagggggtaacggggccttaggggaacggggttcgggggtaccgggtaccggtttaaagttaaaccggaaaaggggtaaaacgtaccgtaaaaccgtaaggtttaaaccaacggttaaccgaaggggaaaacgttacccgggggcggttacccgggttacgtttaggggtaaacggggtaaaaacgggggttaaacggggtttacccaaacccgttaagttaacccgtaaggaaaagtaagtaagtaacggttaaattaaccgaaaaagttaccttaaacgaccgttaaggttactccgtaagtaacctaaaagtaccggaaactacgaccgtaaaacggaaacccggacgggaaccgtacggtaccggttagttaaacgtttagttacggggtaaggttaacgaaaacggtaaaaggtaggttaaggggtagttcgggttagggggagttaacggtcgtggtaaccg

SEQ ID NO: 361630 - DNA, 593 bp, Homo sapiens
  misc_feature: GZ8MTXP02JJYYI.21.4.A04.1.454.CMB.2.raw
  modified_base (216)..(216): a, c, t, g, unknown or other
  modified_base (246)..(246): a, c, t, g, unknown or other
  modified_base (257)..(257): a, c, t, g, unknown or other
  modified_base (279)..(279): a, c, t, g, unknown or other
  modified_base (283)..(283): a, c, t, g, unknown or other
  modified_base (289)..(289): a, c, t, g, unknown or other
  modified_base (292)..(292): a, c, t, g, unknown or other
  modified_base (321)..(321): a, c, t, g, unknown or other
  modified_base (344)..(344): a, c, t, g, unknown or other
  modified_base (349)..(349): a, c, t, g, unknown or other
  modified_base (401)..(401): a, c, t, g, unknown or other
tcagtcgtcgctcgcacgaccggtgctcgattttagagtagtgatcagggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcagctggtggagtctggggganactttggccagcctgggagggtccctgganactctcctgtncagcctctgcatttcacccttnagtnaccaanaanagtgctggtccgcagtcgcgaggggaggntggagtcggcgactatagaaganctaanagtacatacagaactacgcgcgtgtgtagaaaggaagtacgtacactactanaagagagtagtataactaaaacgaaactacactagtactacgtacgaacgtaaactaacgaacgaacgtaccgtaacgaaaaccggaacggaacgaaccggtacgttacgttaacgttacgttacggttacggtaacgtaaacgaaaacgaaggtaaggtagtacggtacgggtaggtacgtacgtacgtcg

SEQ ID NO: 361631 - DNA, 741 bp, Homo sapiens
  misc_feature: GZ8MTXP02FK6QD.21.4.A04.1.454.CMB.2.raw
  modified_base (198)..(198): a, c, t, g, unknown or other
  modified_base (514)..(514): a, c, t, g, unknown or other
tcagtcgtcgctcgcacgaccggtgctcgatttagagtagtgatcagggggaagagctgctcagttaggacccagagggaaccatggaaaccccagcgcagcttctcttcctcctgctactctggctcccaggctcagaaaccacggagaaattgtgttgacgcagtctccaggcacctgttcttgctccgagggaanacgccaccctctcctgcagctccagccagaactctaccagacgtacctactacagtacgcctaggtaccagacaaggaacgccgtcggaccacggtccctaccccgacggtttcccacgtacttctagtcggtccgttaccggggacccccaggacgggcccctacggtcgggacctaccgtcccgacggtacgtacgggtttacagggtcggacgtagggttcggggtacgtgggggaaccaggttacccttacgaccttcgtacctaattactaagttacacgtacggtacgtagggctaccgtagtaacgttnttccgagtagttagttaacttacgtgtactacggtataacggttgttaacggtaacgtttccacccggtttagttcggttacccgggttaccgggtaaccggtaaacggggtaaaccggtttaaaagggtaaaacggttaaaacggtaaccggttaaaaccggtagggttaacggttacggtaacggttaacccgaccgtttaaacgtactttaaccggttttaccg

SEQ ID NO: 361632 - DNA, 854 bp, Homo sapiens
  misc_feature: GZ8MTXP02JYHA0.21.4.A04.1.454.CMB.2.raw
  modified_base (321)..(321): a, c, t, g, unknown or other
tcagtcgtcgctcgcacgaccggtgctcgatttagagtagtgatcaggggagctctgagagcggagccccagccccagaattcccagggtgttttcatttggtgatcagcactgaacacagaggactcaccatggagtttgggctgagtcgttgggttttccttgttgtttattttacaaggtgtcctagtgtgaggtgcagcgtggtggagtcgtgggggatacgttggtccagccgtgggacggtccctgacgactctcctgtgcacgcctctgctacttcaccttcaggtcaaccacaacagtggacgtcgggtcccnccgtacggcctaccggaggggaacgggtgtaggggtacggtcggggtccggaccgtaagtaacgaaagggtaaactacgtaaactacgtaacaacgtaacaggaacgtacggccgtacgtcgtaggtaacggaaaagggtacggttaccaaacccgtagtacccgaagaaaaggtagtacgtaacgtaaacgtttaaccgaaaaacgttaaccttaccgtaaacgtttacgttaacgttccgttaaacggaaccgtaaaaacgttaacgaaaaccccggacccggtaaacccccgggtaaaaccgggtaaaaaaaccccggggaccgggtaaaccccggtaacccccggggggttaatttaccggggttttaaaactttaaacgggggttttaaccggtaaaagggggttttaaaaacggaaaaacccggttaaaaaacggggttgggggtttaaggggtaacccggttttacggggggttaacggggtttaccgggggttacggtaacccggggtttaggtaaaaccccggg

SEQ ID NO: 361633 - DNA, 706 bp, Homo sapiens
  misc_feature: GZ8MTXP02GU1ZF.21.4.A04.1.454.CMB.2.raw
  modified_base (270)..(270): a, c, t, g, unknown or other
  modified_base (321)..(321): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggatacgttggtccagccgtgggacgggtccctgagtactctcctgttagcagccctntgcattcaccttcagtagaccccaacgaaactagtggacttcggggtcccncccgaggcctaccggagggggaaaggggcctggggtaggtggggtaccgggtaccgtaattaacggaaagggtaaaacgcgtaaaccgtaagttacaacgttaacagggtaaactaacggggcgtacgtaccgtggtaagggaaaacggtaacggttccaaaccctacggttacctaacgaaaagagtagtaaggtaactttaacaaaaaaggtaccttcctaaacgtgtttaactcctaggaaacctaaataccgaacgttacacgttaaaacggaaacgtaggcccgaaacggggttctagggttacttagtaggtggtaaaacgtaaaccgaaaaggttggcgtaaagttcggtacgggttaggtacgtcgtagttaacccg

SEQ ID NO: 361634 - DNA, 694 bp, Homo sapiens
  misc_feature: GZ8MTXP02GYH07.21.4.A04.1.454.CMB.2.raw
  modified_base (282)..(282): a, c, t, g, unknown or other
  modified_base (295)..(295): a, c, t, g, unknown or other
  modified_base (521)..(521): a, c, t, g, unknown or other
  modified_base (680)..(680): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtgggacgggtccctgagactctcctgtgcagtcctcgtgctattccaccttnacgtgaaccccanaacagtggaactggggtcccgcaggctaccgaaggggaacgggcgtagggagtcggggtcggtacctaagttaacgaaacgggtaaagcctaaaagtacgttaacaagttaacgaggaaacttacggggccgtacgtacgtagggtaaaggaaaaacgggtacggtttaccaaaccgtagttccaacgaaaaggtagtatacggtaaatacgaaaaagtaccttanacttaggtataccgtagtaccaaaatacgaaactacggtaccgtaaaggaaaaccccggtaggaacccacgggttaccgttagttaatttacggtaggtaaggtaaaaccgtaaacgtaaaaaggtgttaagggaaagttgggttacgggtaggtaacnccggtttggtaaac

SEQ ID NO: 361635 - DNA, 618 bp, Homo sapiens
  misc_feature: GZ8MTXP02G00QA.21.4.A04.1.454.CMB.2.raw
  modified_base (268)..(268): a, c, t, g, unknown or other
  modified_base (276)..(276): a, c, t, g, unknown or other
  modified_base (397)..(397): a, c, t, g, unknown or other
  modified_base (434)..(434): a, c, t, g, unknown or other
  modified_base (453)..(453): a, c, t, g, unknown or other
  modified_base (465)..(465): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttcctgttgttatttacaaggtgtccagtgtgaggtgcagctggtggaggtcgtgggggatacgttggtccaggcccgtgggacgggtccctgacgactctcctagtgcagcctntgcattcnccttacagtcgaccacaacatggacgtggtccgcaggctaccgagggagggctagggaggtgggtcgaccgtagttacgaagaaagtctaaacgagttacagtaacagaaactacggccgngtacgtagagaaagggagtttaccaacctagtcctanaaagtaggaatggttaaanaccgttaaaaanactagtactagtactacgtagaactaacgtacgaaacacgtaacaaacgggaaaccggtaggaaccgtacggtacgttaggttaacttacggttagtacgtaaacgaaacgtaagacggtgtaacgttgggtaggacgtagtacgtaggtacg

SEQ ID NO: 361636 - DNA, 714 bp, Homo sapiens
  misc_feature: GZ8MTXP02F8NDY.21.4.A04.1.454.CMB.2.raw
  modified_base (214)..(214): a, c, t, g, unknown or other
  modified_base (306)..(306): a, c, t, g, unknown or other
  modified_base (347)..(347): a, c, t, g, unknown or other
  modified_base (362)..(362): a, c, t, g, unknown or other
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttatttacaaggtgtccagtgtgaggtgcagctggtggagtcgtggggganacttggtccagccctgggacgggtccctgacgactctcctgtgcagcctctgctattcaccttcagtgaccacaacagtggactggggtccncaggctcgagggaggctggagtgggcgcgtatacaaggaanctaacagtacagtanacgaatacggcgtcgtctagtagaaagggagttccaaaccgtagtaccgtacaaaggtagacgttaggtaactttaacaaaaacggtaccttactaaccgttagggttaacttacccgttaacgaaacttaaaaaccggttacgaaaaccggtaaaccgtaccccggttaaaacggaaaaacccccgggtagggtaaaacccggaaccggggttaacccccggtagttttaaaccgtttaaccggtttaggtaaacgggttaaagtaaaacccggaaaaaggtagggttaaccggggtaaagttcggggtacggggtttaacccgggttaacgtcggtttagggtaaaccgg

SEQ ID NO: 361637 - DNA, 727 bp, Homo sapiens
  misc_feature: GZ8MTXP02IJZBJ.21.4.A04.1.454.CMB.2.raw
  modified_base (197)..(197): a, c, t, g, unknown or other
  modified_base (255)..(255): a, c, t, g, unknown or other
  modified_base (260)..(260): a, c, t, g, unknown or other
  modified_base (265)..(265): a, c, t, g, unknown or other
  modified_base (334)..(334): a, c, t, g, unknown or other
  modified_base (714)..(714): a, c, t, g, unknown or other
tcagtcgtcgctcgcacgaccggtgctcgatttagagtagtgatcaggggagctctgagagcggagccccagccccagaattcccaggtgttttcatttggtgatcagcactgaacacagaggactcaccatggtagtttgggctgagtctgggttttccttgttgttatttacaaggtgtcagtgtgaggtgcagntgggtggaggtgtggggagtacttggtccaggccgtgggaggtccctgagtactctcngtgcngcctntgctatcacctacagtagaccacacagtcggacgtgggtccgccgacggctccggagggggtaaggggngtagggtagggttcggggtaccggtaccgtaacgttacaaaacggggaaacgtctaaactaaggtttacaaacggttacgagggtaaaccgttacggtccgacgttccgttaggtaagggaaaaccgggtaaaggttccaacccgtagtaccttaaccgaaagtacgagttagtaacgttaacaaacgtaactaaccgtaacttaggtaacctgttacggactaaaagttacgaaacgaacgtaaccgtaaacggtaaaacccggaagggtaaaccgaaccggtacccggttagtttaacgttaacggttaaggttaaaggttaacgtaaaacgtaaaaaggtacgtaaggggtaacgtgggttaggttagggtaaacgngtttacggtaagg

SEQ ID NO: 361638 - DNA, 527 bp, Homo sapiens
  misc_feature: GZ8MTXP01CI0BN.21.70.G04.1.454.CMB.2.raw
  modified_base (359)..(359): a, c, t, g, unknown or other
  modified_base (445)..(445): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagccccagggagggctggagtggttgcgagtattttcatgatgggaccacctactataggtcgtcgctcaacagtcgagtcaccatatccgtagacacgtccaggaaccagttctccctgaagctgaactctctcgaccgcgcagacgacgggtatntattattgtgcgagacatagtgtatggctactcgaccctattacgtatggacgtcgtggggccaagggggacgcgagtcaccgtcncctcacgcctccaccaacgggcccaatcgttcctccccttggccgcccttcgcttccaaggagccactccgagaagcaaccg

SEQ ID NO: 361639 - DNA, 529 bp, Homo sapiens
  misc_feature: GZ8MTXP01D88VH.21.70.G04.1.454.CMB.2.raw
  modified_base (464)..(464): a, c, t, g, unknown or other
tcagtcgtcgctcgcacgaccggtgctcgatttagtgtagtgtgaagggaagggtctccgaagccttcggagaccctgtccctcacctgcactgtctctggtggctccatcatcaatggtcattatcactgggctggatccgccagcccccagggaagggctggagtgggttgcgagtattttcatgatgggaccacctactataggtcgtcgctcaacagtcgagtcaccatatccgtagacacgtccaggaacccagttctccctgaagctgaaactctctgaccgccgcagacgcgggtatatattattgtgcgagacatagtggtattggctactcgcccccctattacggtatggacgtctggggccaaaggggaccgcagtcaccgtctcctcagcctccaccaagggcccatcgtctcccctggcgccctgctccgaggagcacctccgagagcacngcggccctgggctgcccttggtcaaggctacttcccgagccgaacgactgagcgggctggcaagg

SEQ ID NO: 361640 - DNA, 541 bp, Homo sapiens
  misc_feature: GZ8MTXP01ENP8S.21.70.G04.1.454.CMB.2.raw
  modified_base (515)..(515): a, c, t, g, unknown or other
  modified_base (527)..(527): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccccctattacggtatggacgtctgggggccaaaggggacccgcagtccaccgtctccctcagcctccaccaacgggcccatccggtcttcccctgccgccctgcctccgacggagccacctccgagacgcacagccggccctgggctgccttggtcaaggctacttcccgngcgaacgactgngcggctggcgaagg

SEQ ID NO: 361641 - DNA, 547 bp, Homo sapiens
  misc_feature: GZ8MTXP01AHBOM.21.70.G04.1.454.CMB.2.raw
  modified_base (539)..(539): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtattttcatgatgggaccactacataggtcgtcgctcaacagtcgagtcaccatatccgtagacacgtccaggaaccagttctccctgaagctcgaactctctgaccgccgcaagacgcgggtatatatttatgtgcgagacatagtggtattggctactcgccctattacggtatggacggttcgtgggggtccaaggggaccgcgacgtcgacccggtctccctcacgccctccaaccaaacgggcccagtccggtcttcccccgttgccgccctcgctccaggacgcnccgtccgg

SEQ ID NO: 361642 - DNA, 435 bp, Homo sapiens
  misc_feature: GZ8MTXP01C8J0L.21.70.G04.1.454.CMB.2.raw
  modified_base (351)..(351): a, c, t, g, unknown or other
  modified_base (427)..(435): a, c, t, g, unknown or other
tcagtcgtcgctcgcacgaccggtgctcgatttagtgtagtgtgaagggaaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttccccctggccgccctgctccaggagcacctccgagngcaccagcggccctgggctgcctggtcaagggactactcccgagcgacgactgagcgggctggcaaggcgcatagnnnnnnnnn

SEQ ID NO: 361643 - DNA, 576 bp, Homo sapiens
  misc_feature: GZ8MTXP01BQ60K.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtctcgctcaacagtcgagtcaccatatccgtagacacgtccaggaacccagttctccctgaagctgaactctctgaccgccgcagacgcggtatatattattgtgcgagacattagtggtattggctactcgccccctatacggtatggacgtcgtggggccaaaggggacccgcacgtccacccgtctccctcacgccctccaccgaacgggccccacgtccggttccttcccccgtggccgccctcgcctccgaggcgccaccgtccgagcgcgaccacggccggcccgtgggcctcgccgttggtccagtacctaccgttcccgcgccgaacgacgtcggacggccgggcgtcggcgaacggg

SEQ ID NO: 361644 - DNA, 571 bp, Homo sapiens
  misc_feature: GZ8MTXP01DKH17.21.70.G04.1.454.CMB.2.raw
  modified_base (534)..(534): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatggaccacctactataggtcgtcgctcaacagtcgagtcaccatatccgtagacacgtccaaggaacccagttctccctgaagctgaactctctgaccgccgcagacgcgggtatatattattgtgcgagacatagtggtattggctactcgccccctattacggtatggacgtcgtggggccaaaggggccgcagtcaccgtctcctcacgcctccaccaacgggcccactccggtccttcccccgtcggccgcccctgcctccggacggacgccacccgtccgacgacgcacacgccggcccgtcgggctcgccttgggtcaacggtacctaccttcccgngccggaacgacgtggacgcgggcgtcgggcgaacggg

SEQ ID NO: 361645 - DNA, 562 bp, Homo sapiens
  misc_feature: GZ8MTXP01CRAPI.21.70.G04.1.454.CMB.2.raw
  modified_base (360)..(360): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactgggctggatccgccagccccagggaagggctggagtgggttgcgagttatttttcatgatgggaccactactataggtctcgctcaacagtcgagtcaccatatccgtagacacgtccaggaaccagttctccctgaagctgaactctctcgaccgcgcagacgacgggtatntattattgtgcgagacatagtgtattggctactcgtcctattacggtatggacgtcgtggggcccaagggggaccgcgacgtccgacccgtccgtcctcacgtccctaccacccgaacgggccccaacgtccggttcccttcccccgttgggcccgccccttgcccttccgaacggcgccacccgtccgacgcgccgaaccg

SEQ ID NO: 361646 - DNA, 537 bp, Homo sapiens
  misc_feature: GZ8MTXP01E01OT.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaagctgaactctctcgaccgcgcagacgcgggtataatattatgtgcgagacatagtgtattggctactcgccctattacggtatggacgtcgtggggccaagggggccgcgagtcaccgtctcctcacgcctccaccaacgggcccaatccggttccttcccccgttgccgcccttcgccttccaaggcgccacctccgagcgcgaaccg

SEQ ID NO: 361647 - DNA, 551 bp, Homo sapiens
  misc_feature: GZ8MTXP01AUYWU.21.70.G04.1.454.CMB.2.raw
  modified_base (474)..(474): a, c, t, g, unknown or other
  modified_base (521)..(521): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattattgtgcgagacatagtggtattggctactcgccccctattacggtatggacgtctggggccaaaggggacccgcagtcaccgtctccctcagccctccaccaagggcccatccggtccttcccccgtggccgcccctgcctccgaggacgccaccctccgacgngcacacgccggccctgggctgcccgttggtccaggactacttcccgngcgaacgactgacgcgggctggcgaacggg

SEQ ID NO: 361648 - DNA, 521 bp, Homo sapiens
  misc_feature: GZ8MTXP01BX0D5.21.70.G04.1.454.CMB.2.raw
  modified_base (439)..(439): a, c, t, g, unknown or other
  modified_base (457)..(457): a, c, t, g, unknown or other
  modified_base (493)..(493): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattattgtgcgagacatagtggtattggctactcgccccctattacggtatggacgtctggggccaaagggccgcagtcaccgtctcctcagcctcaccaaggcccatcgtctcccctgcgccctgctcaggngccacctccgagagcacngcgccctgggctgccttggtcaaggactcttcccgngccgaagactgagcgggctggcgaaggg

SEQ ID NO: 361649 - DNA, 596 bp, Homo sapiens
  misc_feature: GZ8MTXP01A26OV.21.70.G04.1.454.CMB.2.raw
  modified_base (224)..(224): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttatttttcatgatgggaccactactataggtcgtcgctcaacngtcgagtcaccatatccgtagacacgtccaggaaccagttctccctgaagctgaactctctgaccgccgcagacgcggtatatattattgtgcgagacatagtggtattggctactcgcccccttattacggtatggaccgtcgtcgggggccaaaggggacccgcacgtccacccgtctccctcacgccctccaccgaacgggcccacgtccggtcccttcccccgtggcccgccctgccctccggacggacgccacccgtccgagacgccaccgcgcccggcccgtgggcctcggcccgttgggaccaacgggtacctaccgttcccgagcccggaacgacgtcggacggccgggcgtcgggcgaacggg

SEQ ID NO: 361650 - DNA, 534 bp, Homo sapiens
  misc_feature: GZ8MTXP01BZU4F.21.70.G04.1.454.CMB.2.raw
  modified_base (313)..(313): a, c, t, g, unknown or other
  modified_base (515)..(515): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagccccagggagggctggagtggttgcgagtatttttcatgatggggaccactactataggtcgtcgctcaacagtcgagtcaccatatccgtagacacgtccaggaaccngttctccctgagctgaactctctcgaccgcgcagacgcgggtataatattatgtgcgagacatagtgtattggctactcgccctattacggtatggacgtcgtgggccgaacgggggacgcgagtcaccgtctcctcacgcctccaccaacggcccaacgtccgttccttccccgttggccgcccttcgccttccgaaggcncgacctcgagcgcgaaccg

SEQ ID NO: 361651 - DNA, 620 bp, Homo sapiens
  misc_feature: GZ8MTXP01AK9S2.21.70.G04.1.454.CMB.2.raw
  modified_base (337)..(337): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtattttcatgatgggaccacctactataggtcgtcgctcaacagtcgagtcaccatatccgtagacacgtccaggaaccagttcctccngaagctgaactctctcgacccgcccgcaacggacgcggggtaatattattagttgtgcgaagacagtagtgttattggctactcgtcccttagttacggtagtcggtacggggtcgtcgggggccaaaggggcccgcgtacgtcctaacccggtccttccctccacggccccttaacccaacccgaaacggggccccaacgttcccggggttcccttccccccgttgggccccggtcccctcggtcccttacccgacgggttacggtcccaacccgtcccggg

SEQ ID NO: 361652 - DNA, 539 bp, Homo sapiens
  misc_feature: GZ8MTXP01DX2RJ.21.70.G04.1.454.CMB.2.raw
  modified_base (532)..(532): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtagacacgtccaggaaccagttctccctgaagctcgaactctctgaccgccgcaagacgcgggtatatattattgtgcgagacatagtgtattggctactcgcctattacggtatggacggtcgtgggggaccaaaggggaccgcaggtcaccgtctcctcacgcctccaccaagggccccagtccggtccttccccgttgccgccctgcctcaggcgccnccgtccg

SEQ ID NO: 361653 - DNA, 590 bp, Homo sapiens
  misc_feature: GZ8MTXP01B30BR.21.70.G04.1.454.CMB.2.raw
  modified_base (367)..(367): a, c, t, g, unknown or other
  modified_base (382)..(382): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactgggctggatccgccacgccccgagggagggcgtggagtggtgcgtagttatttttcatgatggaccactactataggtctcgctcaacagtcgagtcaccatatccgtagacacgtccaaggaaccagttcctccctgaacgctagaactctctcgacccgcgcgacgacgcgggtaatntatttattgtgcganactagtagttgtattggcttacgtcgtacccttagttacggtatggacgtcgtggggaccaaggggggaccgcgagtccaccgttctccctcacgccctaccgacccgaacgggccctaacgttccggttcccttcccccgttcggcccgtccccgttcgcccttaccgaacgggaccgccgacccgtccggacgaacgccgaaccgg

SEQ ID NO: 361654 - DNA, 558 bp, Homo sapiens
  misc_feature: GZ8MTXP01D6AYP.21.70.G04.1.454.CMB.2.raw
  modified_base (385)..(385): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccccctattacggtatggacgtcgtggggccaaaggggcccncagtccaccgtctccctcacgcctccaccaacgggcccatccggtccttcccccgtggcccgccctcgcctccgaggacgccaccctccgagacgcacacgccggccctcggctgccttggtcaaggctacttcccgcgccgaacgacgtgacggcggacgtcggcgaacggg

SEQ ID NO: 361655 - DNA, 567 bp, Homo sapiens
  misc_feature: GZ8MTXP01AO7SN.21.70.G04.1.454.CMB.2.raw
  modified_base (383)..(383): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtgtattggctactcgccccctattacggtatggacgtcgtggggccaaggggacccnagtccaccgtctccctcagcctccaccgaacgggcccacgtccggtccttcccccgtcggccgccctgcctccgacggacgtccacccgtccgagacgccacacgccggccctcggggctcggccttgggtcaacgggtactacgttcccgagccgaacgcgtcgcggcggcgtggcgaacggg

SEQ ID NO: 361656 - DNA, 710 bp, Homo sapiens
  misc_feature: GZ8MTXP01DQGTB.21.70.G04.1.454.CMB.2.raw
  modified_base (675)..(675): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggacgaccctgtccctcacctgcactgtctctggtggctccatcatcaatggtcattatcacgtggggctggactccgccacgccccgagggagggcgtggagtgggtgcgtagttattttcatgagtcgggacctactactagtaggtcgtcgctacaacagtcgagtcaccatactccgtagacctacgtaccaacggaacctacgttcctccctagaacgtctacgtaacctctctccggaccccgcgacgaacggaccggtaacgggttaattaagttatttaagttgtagacgtaagacgtagttaggttaggttagttcggaccttacgtccgtacccttaagtttacgggtagtcgggtaacgtcggtacgggggaccgtaaacggggggacccgtacgtaccgttcccgtacccggtcccttcccgtaccaccgtcccctaccccgaaaccggaacccgggtccccttaacgttccccggttccccgttcccccggttcgggtccccgtcccgttcgttcccgttcccggaacgggtaccncccgaaccccgtcggaacgtcgaacccgaaccggg

SEQ ID NO: 361657 - DNA, 568 bp, Homo sapiens
  misc_feature: GZ8MTXP01BSB7L.21.70.G04.1.454.CMB.2.raw
  modified_base (218)..(218): a, c, t, g, unknown or other
  modified_base (379)..(379): a, c, t, g, unknown or other
  modified_base (531)..(531): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagccccagggagggctggagtggtgcgagtatttttcatgatgggaccacctactataggtcgtcgctcaacngtcgagtcaccatatccgtagacacgtccaggaaccagttctccctgaagctgaactctctgaccgcgcagacgcgggtatatattatgtgacgagacatagtggtattggctactcgccccctattacggtatggacgtcgtggggccaaagggacccgnagtccaccggtctcctcagccctccaccgaacgggcccagtccggtacttcccccgtgccgcctcgcctccgacggacgccaccgtccgagacggcacgacgccggcccgtggggctcgccttcgggtacaagggtccttaccgttcccggngttccgaacgcctggacggcgggctcgggcgaacggg

SEQ ID NO: 361658 - DNA, 577 bp, Homo sapiens
  misc_feature: GZ8MTXP01D6759.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccagggaagggctggagtgggttgcgagtattttcatgatggaccacctactataggtctcgctcaacagtcgagtcaccatatccgtagacacgtccaggaaccagttctccctgaagctgaactctctcgacccgcgcagacgcggtatatattatgtgcgagacatagtggtattgctactcgccccctattacggtatggacgtcgtggggccaagggacccgcacgtccaccgtctccctcacgcctccaccgaacgggcccctaacgttcccgggttcccttccccccgtggccccgtccccgtcgcctccggacggacgccaacccgtccgagacgaccacgacgcccggcccgtcgggctcgccttggtcaaaggacctacgttcccgagccgaacgacgtgcgcgggctggcgaacgg

SEQ ID NO: 361659 - DNA, 579 bp, Homo sapiens
  misc_feature: GZ8MTXP01BH7H2.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccaggggaaggggctggagtgggttgcgagttatttttcatgatgggaccacctactataggtcgtcgctcaacagtcgagtcaccatatccgtagacacgtccaggaaccagttctccctgaagctgaactctctgaccgccgcagacgcggtatatattattgtgcgagacatagtggtattggctactcgccccctattacggtatggacgtcgtggggccaaaggggcccgcaggtccaccggtctccctcacgccctccaccaacgggccccacgtccggtccttcccccgtggcccgccctgcctccgacggcgccaccgtccgacgacgcacgcgcccggcccgtgggcctcggcccttgggtccaaacgggtacctaccgttcccgagccgaacgcgtggacgcgggactgggcgaacgg

SEQ ID NO: 361660 - DNA, 553 bp, Homo sapiens
  misc_feature: GZ8MTXP01D0YVR.21.70.G04.1.454.CMB.2.raw
  modified_base (384)..(384): a, c, t, g, unknown or other
  modified_base (515)..(515): a, c, t, g, unknown or other
  modified_base (520)..(520): a, c, t, g, unknown or other
  modified_base (542)..(542): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccagcccccgagggaagggctggagtgggttgcgtagttatttttcatgagtgggaccacctactagtaggtcgtcgctcaacagtcgagtccaccatatccgtagacacgtccagaaccagttctccctagaacgctagaactctctcgaccgcgcagacgacgggttataatattattgngcgagactatagtagtattggctactcgtaccttagtttacggtatcggacgtcggtacgggaccgaagggggaccgcagtccaccgtctcctcacgccctaccacgacggccaacgtcgttcctccccgngcccnccttcgccttccaagcgcaccncgagcgcaacg

SEQ ID NO: 361661 - DNA, 584 bp, Homo sapiens
  misc_feature: GZ8MTXP01AWOPU.21.70.G04.1.454.CMB.2.raw
  modified_base (319)..(319): a, c, t, g, unknown or other
  modified_base (418)..(418): a, c, t, g, unknown or other
  modified_base (527)..(527): a, c, t, g, unknown or other
  modified_base (559)..(559): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaagggctggagtgggttgcgagttatttttcatgatgggaccactactataggtcgtcgctcaacagtcgagtcaccatactccgtagacacgtccaggaaccngttcctccctgaagtctgaactctctcgaccgcgcagaccgacgggtataatattatgtgcgagacatagtggtatggctactcgacctagttacggtnggacgtcgcggggtaccaacggggggccacgagtcccgacccgttcgtccctcgaacgtcccctaccacccgaaacgggccccaacgttcccggttccctttcccccgnggtccccgcccttcgcccgttacgaacgggcncccacccgtcgacgcgccaaccggg

SEQ ID NO: 361662 - DNA, 575 bp, Homo sapiens
  misc_feature: GZ8MTXP01BPFCP.21.70.G04.1.454.CMB.2.raw
  modified_base (378)..(378): a, c, t, g, unknown or other
  modified_base (536)..(536): a, c, t, g, unknown or other
tcagtcgtcgctcgcacgaccggtgctcgatttagtgtagtgtgaagggaaagggtctccgaaggcttcaccagtcctgtctcagctgcagctgcaggagtcgggcccaggactggtgaagccttcggagaccctgtccctcacctgcactgtctctggtggctccatcatcaatggtcattatcactgggctggatccgccagcccccagggaagggctggagtgggttgcgagttatttttcatgatgggaccactactataggtcgcgctcaacagtcgagtcaccatatccgtagacacgtccaaggaaccagttccctcctgaagtctagaactctcctgaccgccgcagaacgcgggtaatattattattgngtcgagacagtagtggtattggctactcgtacccttagttacggtatcggacgtcgtcgggggaccaaacgggggcccgacgacgtccaccccgtcttccctcgacgtcccctacccaccgaacgggccctagttcccggtcccttccccgtggcccncccgttgcctccgacggcgcccaccgccgaagaacgccg

SEQ ID NO: 361663 - DNA, 564 bp, Homo sapiens
  misc_feature: GZ8MTXP01BU5U3.21.70.G04.1.454.CMB.2.raw
  modified_base (387)..(387): a, c, t, g, unknown or other
  modified_base (445)..(445): a, c, t, g, unknown or other
  modified_base (481)..(481): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaacccagttctccctgaagctgaactctctgacccgccgcagacgcgggtatatattattgtgcgagacatagtggtattggctactcgcccccctattacggtatggacgtcgtggggcccaagggcccnagtccaccgtctccctcagccctccaccaagggcccatccggtccttccccgtggccnccctgcctccgaggacgccaccctccgagacgcacncgccggccctggggctcggccgttgggtccaagggcctacgttccccgagccgaacgacgtgacggcgggctgggcgaacggg

SEQ ID NO: 361664 - DNA, 578 bp, Homo sapiens
  misc_feature: GZ8MTXP01DR45M.21.70.G04.1.454.CMB.2.raw
  modified_base (383)..(383): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccccctattacggtatggacgtctggggccaaagggcccnagtcaccgtctcctcagcctccaccaacgggcccagtccggtccttcccccgtggccgcccctgcctccgacggacgccacccgtccgacgcgcgacacgccggcccgtggggcctcgccgttgggtaccaaacgggtacctaccgttaccccggagttccgaacgacgtggacggccggggctgggcgaacggg

SEQ ID NO: 361665 - DNA, 560 bp, Homo sapiens
  misc_feature: GZ8MTXP01C0JO5.21.70.G04.1.454.CMB.2.raw
  modified_base (298)..(298): a, c, t, g, unknown or other
  modified_base (441)..(441): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactggggctggatccgccagccccagggagggctggagtgggtgcgagtatttttcatgatgggaccactactataggtcgtcgctacaacagtcgagtcaccatactccgtanacacgtccaggaaccagttctccctgaacgctagaactctctcgaccgcgcagacgcgggtatgtattatgtgcgagacatagtgtattggctactcgacccttagttacgtagtggacgtcgtggggaccaaggggggccgngacgtcacccgtctcctcacgtcctaccaccgacggccctaacgtccgttcccttccccgcggtccctcccgttcgccttaccgaacggcgcccgacccgacgacgccgaacaacccgg

SEQ ID NO: 361666 - DNA, 652 bp, Homo sapiens
  misc_feature: GZ8MTXP01ADMLP.21.70.G04.1.454.CMB.2.raw
  modified_base (218)..(218): a, c, t, g, unknown or other
  modified_base (286)..(286): a, c, t, g, unknown or other
  modified_base (376)..(376): a, c, t, g, unknown or other
tcagtcgtcgctcgcacgaccggtgctcgatttagtgtagtgtgaagggaaaggtctccgaagccttcggagaccctgtccctcacctgcactgtctctggtggctccatcatcaatggtcattatcactgggctggatccgccagccccagggagggctggagtggttgcgagtattttcatgatgggaccacctactataggtcgtcgctcgaacngtcgagtcaccatatccgtagacacgtccaggaccagttctccctgaagctgaactctctgaccgcgnagacgcggtatatattatgtgcgagacagtagtggtattggactactcgccccttattacggtatggacgtcgtggggccaaaggggccnacgtcaccgtctcctcacgccctaccaccgaacgggccccaagttccgggtacccttacccccgtgggacccgccccgttgcccttcccggaagggtacgtcccaacccgtccggaagacgaccaaccgacggcccgggtacccgtggggcccttaacgggcccgtttcggggaccgaaacgggtacccttaaccccgtttccccggaacggttcccggaaccgggtaccgtcgggaaccgggcccgggggttaccgtcggggaaccgaaccgggg

SEQ ID NO: 361667 - DNA, 589 bp, Homo sapiens
  misc_feature: GZ8MTXP01EKATK.21.70.G04.1.454.CMB.2.raw
  modified_base (321)..(321): a, c, t, g, unknown or other
  modified_base (326)..(326): a, c, t, g, unknown or other
  modified_base (558)..(558): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatgtcattatcacgtggggctggactccgccacgccccgagggagggctggagtggttgcgtagttattttcatgagtcgggaccactactagtaggtctcgctacaacgagtcgagtcaccatactccgtagacacgtacaggaaccngttcnccctagacgctacgaactctctcgacccgcgacagacgtacgggttaataagtattagttgtgacgagactagtagtgtatggctactcgtacctagttacgtgtcggacgtcggtacggggacccgaagggggacccgcgtaacgtccgaccgtcctcctcgaccgtccctacccgacgtaacggccctaacgtccgttccctccccgttgcccgtcccttcgccttccgngggcctccacccgtccgagccgcgaacccgg

SEQ ID NO: 361668 - DNA, 589 bp, Homo sapiens
  misc_feature: GZ8MTXP01BSAJD.21.70.G04.1.454.CMB.2.raw
  modified_base (386)..(386): a, c, t, g, unknown or other
  modified_base (463)..(463): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccgagggaaggggctggagtgggttgcgagtatttttcatgatggaccactactataggtcgtcgctcaacagtcgagtcaccatactccgtagacacgtccaggaacctagttcctccctgaagctagaactctctgacccgcgcagacgcggtatatattatgtgacgagacatagtgtattggctactcgcccctattacggtatggacgtcgtcggggccgaaaggggcccncgacgtccacccgtctccctacacgccctaccgaccgtaaacgggcccaacgttcccggttcctcccccgtggcccnccctgcctccgaggccgccacccgtcgagacgcgaacgcgtccggccctgggcctcgcccgttggtaccaaaggacctaccgttccccggagccgaacgcgtggacgcgggttacgtcggcgaacg

SEQ ID NO: 361669 - DNA, 606 bp, Homo sapiens
  misc_feature: GZ8MTXP01DITG1.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtatttttcatgatgggaccactactataggtcgtgctcaacagtcgagtcaccatatccgtagacacgtccaggaaaccagttctccctagaagctgaaactctctcgaccgcgcagacgcgggtataatattattgtgcgagacatagtgtattggctactcgaccctatttacggtattgggaacgtcgtcgggggaccgaaaggggggtacccgcgtaacgtccgaacccggtccttcccgtcaaacgtcccctaccaacccgaaacggggcccctaacgtccgggttccctttccccccgttcggtcccgccccgttcggccttccccgtaagggacgccaacccgtcccggacgaacgccgaaccg

SEQ ID NO: 361670 - DNA, 624 bp, Homo sapiens
  misc_feature: GZ8MTXP01E22ZA.21.70.G04.1.454.CMB.2.raw
  modified_base (385)..(385): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctcgaccgccgcagacgcggtatatattattgtgcgagacatagtggtattggctactcgtccccctattacggtatggacgtcgtggggccaaaggggccncagtccaccgtctcctcacgccctaccgaccgaaacgggcccctacgtcccgggttcccttccccccgtcggcccgccccgttcgcccgtacccggaacgggacgcctacccgtcccgagacgccaacgacggcccgggcccgtcgggggcctcggtccgttcggggtaccgaaacgggtaccctaccgttccccggagcccggaacgaccgtggacgggcgggcgtcgggcgaacggg

SEQ ID NO: 361671 - DNA, 603 bp, Homo sapiens
  misc_feature: GZ8MTXP01ALG71.21.70.G04.1.454.CMB.2.raw
  modified_base (326)..(326): a, c, t, g, unknown or other
  modified_base (476)..(476): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggcgtggaggtgggttgcgagtatttttcatgatgggaccacctactataggtcgtacgctcaacagtcgagtcacatatccgtagacacgtccaggaccagttcnccctgaagctgaactctctacgaccgcgtcgagacgcgggtataagtattagttgtgcgagacatagtggtattggctactcgcctattacgtagtggacgtacgtggggtacccgaagggggacccgtcgacgtcccgtacccgttccncccgttcaacggtccctcccacccgaacgggcccctaacgttcccggttcccttccccccgttggccccgtcccgttcggccttacccgaaggaccgtccacccgtccggacgaacgcccgaaccgg

SEQ ID NO: 361672 - DNA, 563 bp, Homo sapiens
  misc_feature: GZ8MTXP01EKBC0.21.70.G04.1.454.CMB.2.raw
  modified_base (441)..(441): a, c, t, g, unknown or other
  modified_base (531)..(531): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattatgtgcgagacatagtggtattggctactcgccccctattacggtatggacgtcgtggggccaaaggggccgcagtccaccgtctccctcacgcctccaccgacggaaacccacgtccggtccttcccccnggccgccctgcctccgaggcgccacccgtccgagcgcaccgacgccggcccgtggacctcgccgttggtccgaagtacctacgttcccgngccgaacgacgtgacggcgggctggcgaacgg

SEQ ID NO: 361673 - DNA, 651 bp, Homo sapiens
  misc_feature: GZ8MTXP01C2HUO.21.70.G04.1.454.CMB.2.raw
  modified_base (369)..(369): a, c, t, g, unknown or other
  modified_base (611)..(611): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaagggctggagtgggttgcgtagtatttttcatgatggaccacctactataggtcgtcgctcaacagtcgagtcaccatatccgtagacacgtccaggaccagttctcctgaagctgaactctctcgaccgccgcaggacgcggtaatattattatgtgacgagactagttagtgtattggactacgtccgtacccccttaagttacggtntcgggacgttcggtacgggggaacccgaaacggggacccgactacggtacccacccgttcctccctaccacgcccctacccgaaccgaacggcccacgttcccggttcccttcccccgtcggcccgtcccgtcgccctaccgggaacggaccggacccacccgtccgacgaccgccgaaccgcggcccggtcccgtcgggcctcggccgttacggtaccaacggtaccctaccgttacccgngaccgaacgacgtcggacggtcgggcgtcggaacgaacgg

SEQ ID NO: 361674 - DNA, 641 bp, Homo sapiens
  misc_feature: GZ8MTXP01DY0F7.21.70.G04.1.454.CMB.2.raw
  modified_base (465)..(465): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgtagtatttttcatgatggaccacctactataggtcgtcgctcaacagtcgagtcaccatatccgtagacacgtccaaggaccagttctccctgaagctgaactctctcgaccgccgcagacgcggtaatattatttatgtgcgagactagttagtggttattcggctactccgtccccctagttacggtagtggtacgtcgtacggggccaaaggggacccgcgacgtccaccgtctccctcacgccctaccaccgaacgggccctacgttccggtcccttcccccgnggcccgccctgccctcgggacggacgtccacccgtccgaagcgccaacgcggcccggtcccgtggggccctcggtcccgttcgggtaccgttaaacgggtacccttacccggtttaccccggaggaccccgtaacgtcgggaacgggccgggtcgttacggggcccgaagggcccg

SEQ ID NO: 361675 - DNA, 602 bp, Homo sapiens
  misc_feature: GZ8MTXP01D2TOK.21.70.G04.1.454.CMB.2.raw
  modified_base (482)..(482): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgatcaccatatccgtagacacgtccaggaacccagttctccctgaagctgaactctctgacccgccgcagacgcgggtaatatattattgtgcgagacatagtggtattggctactcgtccccctattacggtatcggacgtcgtggggccaaagggacccgcagtcaccgtctccctcacgcctccaccgaaacgggcccaactccggtcttcccccgtcggccgccctcgccgtccgaacggacgcctacccnccgaacgacgacaccgacgccggccccgtcggggcctcggccttcgggtaccaaacgggtaacctaaccgtttccccggagacccgaacgaaccgcggacgggcgggcgtcggcgaacgg

SEQ ID NO: 361676 - DNA, 553 bp, Homo sapiens
  misc_feature: GZ8MTXP01AM9F2.21.70.G04.1.454.CMB.2.raw
  modified_base (320)..(320): a, c, t, g, unknown or other
  modified_base (347)..(347): a, c, t, g, unknown or other
  modified_base (379)..(379): a, c, t, g, unknown or other
  modified_base (535)..(535): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactgggctggatccgccagcccccagggaagggctggagtgggtgcgagttatttttcatgatgggaccacctactataggtctcgctcaacagtcgagtcaccatatccgtagaccacgtccaggaaccagttcnccctgaacgctgaactctctcgacccncgcagacgcgggtatgttattacttgtgcganacatagtggttatggctactcgccctagttacggtatgggacgtcgtacggggcgaacgggggccgacgacggtccacccgtctccctcgacgccctaccaccgacggcccaatccgttcctccccttggcccgcccttcgccttccgaaggaccnccgaccgcgagtcgcgcg

SEQ ID NO: 361677 - DNA, 603 bp, Homo sapiens
  misc_feature: GZ8MTXP01A1WLC.21.70.G04.1.454.CMB.2.raw
  modified_base (306)..(306): a, c, t, g, unknown or other
  modified_base (331)..(331): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtgggctggactccgccacgcccccgaggggaagggcgtggagtgggttgcgtagttatttttcatgatcgggaccacctactataggtcgtcgctcacagtcgagtcacatatccgtanacacgtccaggaaccagttctcccngaacgctagaactctctacgaccgccgcacgacgacgggttaataatattagttgtgcgagacatagtgtattggctactcgtaccctagttacggtagtaggacgtcgttggggaccgaaacgggggaccgcgtacgtcgaccgtctaccctctacgccctcccgaccgtaacggggcccctaacgtcccggttcccttccccccgttggccccgtccccgttcgccttaccgcgggacgcccaacccgtccggacgaacgccgaacccgg

SEQ ID NO: 361678 - DNA, 822 bp, Homo sapiens
  misc_feature: GZ8MTXP01DBNLT.21.70.G04.1.454.CMB.2.raw
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtgctccatcatcaatggtcattatcacgtgggctggatccgccacgcccccgaggggaacgggctggagtgggtgcgtagttattttcatgatggaccactatataggtctcgctcaaacagtcgagtcacctatactcccgtagacctacgtaccaacgggtaaacccagtttcctaccccgtaggaaacgtccttacggaaacctttcctacgttaccgggacccccgaccccgggacaacgggaaccgggtacccgggggttaaattaattaacgtttaagttcggtgaccggtaagaacctaagttaagggtggtttaaacgttggtacccttaacttcccggtaccccttaagtttaaccgggttagtccgggggtaaacgggtttccggggttaccgggggaacccgtaaacggggggtaaccccacggtaaccggttcccgtaaaccccggtcccttccccgttaccgaacccgggtccccttaaccccgaaacccggttaaacccgggggtcccccttaaacggttaccccgggtttccccctttccccccccgggttcgggttacccccgttccccccgttaacgggccccttaaccccgggaacggggaacccgttcccccgaaccccgttaacccgggg

SEQ ID NO: 361679 - DNA, 585 bp, Homo sapiens
  misc_feature: GZ8MTXP01CJGR8.21.70.G04.1.454.CMB.2.raw
  modified_base (317)..(317): a, c, t, g, unknown or other
  modified_base (322)..(322): a, c, t, g, unknown or other
  modified_base (470)..(470): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatgtcattatcactgggctggatccgccacgccccagggagggctggagtgggttgcgtagttatttttcatgatcgggaccactactagtaggtcgtcgctacaacagtcgagtcaccatatccgtagacacgtccaggaaccngttcnccctagacgctgaactctctcgaccgcgcagacgacggtatgtattatgtgcgagacatagtgtattggctactcgaccttagttacggtagtggacgtcgtaggggaccgaacggggggtaccgcgtacgtaccgtacccgttaccnccgtacaccggtccctacccgaccgaaaccgggcccaacttccggttcccttcccccgttggccccgccgttcggccttcccggaagacgcccaccgccgacgccgcgtaaccgg

SEQ ID NO: 361680 - DNA, 613 bp, Homo sapiens
  misc_feature: GZ8MTXP01BFLV7.21.70.G04.1.454.CMB.2.raw
  modified_base (305)..(305): a, c, t, g, unknown or other
  modified_base (326)..(326): a, c, t, g, unknown or other
  modified_base (368)..(368): a, c, t, g, unknown or other
  modified_base (377)..(377): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtgggctggactccgccacgccccgagggaagggctggagtgggttgcgtagttatttttcatgatcgggaccacctactagtaggtcgtcgctcaacagtcgagtcacatatccgtanacacgtccaggaaccagttcnccctgaacgctagactctctcgaccgcgcagcgacgggtatntattattgngcgagacatagtgtattggctacgtcgcccttagttacggtatggacgtcgtggggaccgaaggggggaccgcgtacgtccaccggttcctcccgtcgaccgtcccctacccgacccgaaaccggggcccctaacgttcccgggttccctttccccccgttcgggtccccgtccccgttcggcccgttcccgaacgggacgcccgtaacccgtccggacgtaacgcccgaacccgg

SEQ ID NO: 361681 - DNA, 565 bp, Homo sapiens
  misc_feature: GZ8MTXP01BD20D.21.70.G04.1.454.CMB.2.raw
  modified_base (430)..(430): a, c, t, g, unknown or other
  modified_base (468)..(468): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctcccctgaagctgaactctctgaccgccgcagacgcgggtatatattattgtgcgagaaccctagtgtatgctactcgccccctattacggtatggacgtcgtcggggccaagggaccgcagtcaccgtctcctcacgctccaccacggcccactcgtctccccncgccgccctgctccgagcgcaaccctccgacacgcacncgccgggcccgtcgggcgtcgccgttcgggtaccaagggtacctaaccgttcccggcgccggaacgaacgtcgaacggcgggcgtcgggcgaacggg

SEQ ID NO: 361682 - DNA, 729 bp, Homo sapiens
  misc_feature: GZ8MTXP01DEXVM.21.70.G04.1.454.CMB.2.raw
  modified_base (695)..(695): a, c, t, g, unknown or other
tcagtcgtcgctcgcacgaccggtgctcgattttagtgtagtgtgaagggaaagggtctccgaaggcttcaccagtcctgtcccagctgcagctgcaggagtcgggcccaggactggtgaagccttcggacgaccctgtccctcacctgcactgtctctggtgctccatcatcaatgtctattatcacgtggggctggactccgccgacgccccgagggagggcgtggagtggttgcgtagttattttcagtgtagtcggacctacgtactagtacggtcgtcgctacaacgagtcgagtccacctatactaccgtagaccacgtaccgaacggtaaccctagttcctcccgtaagaacgtctacacttctctcccgaccgcgacgacgacggtaacggttaattaattatttagttgtacgacgtaagtactaagttaggttagttagttcggtaccttaccgttacccgtacccgtttaagttaacggttcggtacggtacggttccgggtacggggaacccggaacgggggtcccgacgttaccggtaccctacccgttccctcccgtacgaacccgtcccctaaccggaacccgtaacccgggtccccgttaaccggttttcccccggttccccgttttccccccggcggtcccccgtccccgttacggccccgttaccggaacgggaccncccgttacccgacggacgaaccgccgaacccggg

SEQ ID NO: 361683 - DNA, 656 bp, Homo sapiens
  misc_feature: GZ8MTXP01CDTTT.21.70.G04.1.454.CMB.2.raw
  modified_base (282)..(282): a, c, t, g, unknown or other
  modified_base (300)..(300): a, c, t, g, unknown or other
  modified_base (319)..(319): a, c, t, g, unknown or other
  modified_base (345)..(345): a, c, t, g, unknown or other
  modified_base (370)..(370): a, c, t, g, unknown or other
  modified_base (518)..(518): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcacgtgggctggactccgccacggcccccgaggggaacgggctgggagtgggttgcgtagttattttcatgatgggacctactanataggtctcgctacaacngtcagtcacatatccgtanacacgtaccaaggaaccctgtttccnccctagaaacgtctacgtaaccttntaccgtcgaaccccgccgacaacggacgggtaccgggttaattatatttagtgtcgcgagaacagttaggtgtagttacggtcttacgtccgttaccttaagttacggtatacgggacggttcggtacgggggaccaaacggggaccnccgtacggtcctaaccccggtcctacccgtcgaccgtcccctaacccgaacgaaccgggtcccttaacgtccgggttccccttaccccgttcggcccgtccctcggtcccacggacggcctaacccggaaccgtccgg

SEQ ID NO: 361684 - DNA, 623 bp, Homo sapiens
  misc_feature: GZ8MTXP01DKG3C.21.70.G04.1.454.CMB.2.raw
  modified_base (346)..(346): a, c, t, g, unknown or other
  modified_base (367)..(367): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactgggctggatccgccagccccagggaagggctggagtgggtgcgtagttatttttcatgatgggacctacctactataggtcgtcgctacaaacagtcgagtcaccatactccgtaagacacgtccaggaaccagttctccctganctacgactctctcgaccgccncaagacgcgggtatattattattgtgacgagactagtagtggttattaggcttactccgtccttagttacggtagtcgggaacgggttcgtacgggggaccgaaacgggaccgcgacgtccacccggtctcctccgacgtccctaacccgaacccgaacggggtcccaacgttcccggttccccttcccccgttcggggccccgtccccgttacgccccgttccggacgggaccgcccgttaacccgtaacccggg

SEQ ID NO: 361685 - DNA, 705 bp, Homo sapiens
  misc_feature: GZ8MTXP01CGHBR.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggacgaccctgtccctcacctgcactgtctcgtggtgctccatcatcaatggtctattatcacgtgggctggactccgccacgccccgagggagggctggagtggtgcgtagttattttcatgagtcggaccactactagtaggtcgtcgctacaactagtcgagtccaacctaatactaccgtaagacctaaccgtacccgaacggtaaccctacgtttcctaccccgtagaacgtcctagtaacctctcgtcccgaccgccgacgacggaccggtaacgggttaattaattatttagttcggtcgacgaacgtactagttaggtagttagttcggacttaccgtccgtacccgtttaagttaacggtgttacgggaccgttcggacgggggtaaccccgaaacggggggacccgtacgtaccgtacccgtacccgttaccttcccgacgtaccgtcccctaacccgaacccgaccgggccctaaccgttcccggtttccccttccccgttggccccgtccgttccgccgttcccgaaggtccgaaccgtacccgtaccggaacgtccgcgaacccgg

SEQ ID NO: 361686 - DNA, 570 bp, Homo sapiens
  misc_feature: GZ8MTXP01A6SDD.21.70.G04.1.454.CMB.2.raw
  modified_base (360)..(360): a, c, t, g, unknown or other
  modified_base (381)..(381): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactgggctggactccgccagcccccgagggaagggctggagtgggttgcgagttatttttcatgatcgggaccactactagtaggtcgtcgctacaacagtcgagtcaccatactaccgtagacacgtccaaggaacctagttctccctagaacgctagaactctctcgaccgcgnagatgcggtaatatattatgngacgagacagttagtggtattggctactccgtacccttagttacggatggtacgtcgtcggggaccgaaggggaccgcacgtcgacccgtcctccgcacgtccctaccgaccgaacgggccctacgttccggtcccttccccggcgtcccgcccgttgcctccgagcgccaccgttcgaacgcgaaccg

SEQ ID NO: 361687 - DNA, 676 bp, Homo sapiens
  misc_feature: GZ8MTXP01A984I.21.70.G04.1.454.CMB.2.raw
  modified_base (327)..(327): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccgagggaagggctggagtgggttgcgtagttatttttcatgatgggaccactactatacggtctcgctcaacagtcgagtcaccatatccgtagacacgtaccaggaacctgttcnccctgaagctagactctctcgaccgcgcgagacgtacgggtataacgtattagtgtgacgagactagtagtgtagtggtctacgtcgtacccgtagtttacggagtcgggacgttcggtacgggggaccaacggggggggaccccgtacgtaaccgtccgtaaaccccggttcccttcccgtaccgtaaccggtccccctaacccgaaccccggtaaaccggggcccctaacggttccccgggttcccctttccccccggttcgggacccccggtccccgttcggcccgttacccgaacggggtaccccgtcccgtaccccggtaccggacgtaaccgaaccgaaccgg

SEQ ID NO: 361688 - DNA, 538 bp, Homo sapiens
  misc_feature: GZ8MTXP01DF2YN.21.70.G04.1.454.CMB.2.raw
  modified_base (224)..(224): a, c, t, g, unknown or other
  modified_base (284)..(284): a, c, t, g, unknown or other
  modified_base (423)..(423): a, c, t, g, unknown or other
  modified_base (474)..(474): a, c, t, g, unknown or other
  modified_base (506)..(506): a, c, t, g, unknown or other
  modified_base (519)..(519): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaaacngtcgagtcaccatatccgtagacacgtcaggaaccagttctccctgaagctgaactctcngaccgccgcagacgcgggtatatattatgtgcagacatagtgtattgctactcgcccctatacgtatggacgtctggggccaaagggccgcagtccacgtctccctcagcctccacaacggcccactcgttcttccccnggcgccctgcctccgagacgcacctccgagacgcacgagccggcctcgggntcgcttcggtcaacgggtactaacttcccggngccgaagacctgnggacgggctggccgaaggg

SEQ ID NO: 361689 - DNA, 644 bp, Homo sapiens
  misc_feature: GZ8MTXP01DVD93.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcactggggctggactccgccacgccccgagggagggctggagtggttgcgtagttattttcatgatggaccactactagtagtcgtcgctcaacagtcgagtcaccatatccgtagacacgtccaggaaccacgttctaccccgtgaacgtctacgaactctcgtccgaccgaccgcgacgacgtacgggttaattaagtatttagttagtgaccgaagtactagttagttggttagttcgcgttacttccgtacccttaagttacggtatcgggaacgtcggtaggggaccgaacggggggacccgtacgtacgttccgaccgtcctcccgtacaacggtccctacccgaaccgtaaccggcccgaacttcccggttacccgttcccccgttcgtcccgcccgttcgccgttacccgaacgggactcccgtacccgtccgacgtaaccggcctaacccgg

SEQ ID NO: 361690 - DNA, 662 bp, Homo sapiens
  misc_feature: GZ8MTXP01AUU4K.21.70.G04.1.454.CMB.2.raw
  modified_base (361)..(361): a, c, t, g, unknown or other
  modified_base (372)..(372): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcacgtggggctggactccgccacgcccccgaggggaagggctggagtgggttgcgtagttatttttcatgatcgggaccactactataggtcgtcgctacaacaggtcgagtcaccatactaccgtagaccacgtccgaaggaacctagttcctacccgtgaanctcgaacctcnctcgacccgccgacaacgacggtacgggttatacgttaattagtcggttgacgagactagttaggtggttaattcgggcttaaccgtccgtaccgttaagtttaccggtagttacgggtacggggttcgggtacgggggacccaaacgggggaccgcgaccggttaccacccggtcctacccttcacccgccctaacccgaaccgacggggtccccacgttccgggttccccttcccccggttggccccgtcccgttcgcccgttccgacggccgtccgcccgtaaccgg

SEQ ID NO: 361691 - DNA, 662 bp, Homo sapiens
  misc_feature: GZ8MTXP01BBDTK.21.70.G04.1.454.CMB.2.raw
  modified_base (253)..(253): a, c, t, g, unknown or other
  modified_base (275)..(275): a, c, t, g, unknown or other
  modified_base (309)..(309): a, c, t, g, unknown or other
  modified_base (426)..(426): a, c, t, g, unknown or other
  modified_base (495)..(495): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccacgcccccgaggggaaggggctggaggtgggttgcgtagttatttttcatgatcgggaccacctactagtaggtcgtcgctacaacagtcgagtcacatatccgtanacacgtcaggaacctagttccnccctagaagctgaacctctactcgacccgccganacggacgtcgggtaatattatttagttgtggacgagactgttaggtgttattggctacgtcgtcccccttaagttacggtatcggggacgttcggacggggaaccgaaggggacccncgacgtccaccgtctcctcacgccctaccgaccgaacgggccctacgttcccgggttcccttcccccgngggcccctccccgtcgtacctccggggacggtaccgacccaccccgtccgagaccgcgaaccgacggcccgggtcccgtgggcctcggccgttcgggtacaaacggaccttacccgttcccgagcccggtaacgacgtgggacgggcgggccgtcgggcgaaccggg

SEQ ID NO: 361692 - DNA, 595 bp, Homo sapiens
  misc_feature: GZ8MTXP01DUDSF.21.70.G04.1.454.CMB.2.raw
  modified_base (390)..(390): a, c, t, g, unknown or other
  modified_base (460)..(460): a, c, t, g, unknown or other
  modified_base (500)..(500): a, c, t, g, unknown or other
  modified_base (559)..(559): a, c, t, g, unknown or other
  modified_base (573)..(573): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctggagtgggttgcgagtatttttcatgatggaccactactataggtcgtcgctcaacagtcgagtcaccatatccgtagacacgtccaaggaccagttctccctgaagctgaactctctgacccgcgcagacgcggtaatagttattattgtgcgagactagtagtggtattggctactcgcccccttattacggtatcggacgtcgtcggggccaaaggggccncaagtccaaccgtctccctcacgtccctaccaccgaacgggcccctaacgtcccggttcccttcccccgnggcccgccctcgcctccggaggacgcctaccgccgagacncgaacgacgccggcccgtggctcggtccgttggtacaaacgggtcctaccgttcccggngaccgaacgtacgnggacgcgggctgggccgaaggg

SEQ ID NO: 361693 - DNA, 666 bp, Homo sapiens
  misc_feature: GZ8MTXP01CSX1M.21.70.G04.1.454.CMB.2.raw
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcacgtggggctggatccgccacgccccgagggaagggctggagtgggttgcgtagttatttttcatgatcgggacctactactataggtcgtcgctcaacagtcgagtcaccatactccgtagacacgtccaacggtaaccagttcctaccctagaacgctacgtaaacctcgtctacgaccccggaccgcgaacggaccggtcggggttaaattaagttactttaagtttgtacgggtaccgaagtaacgtaagttaggttacggttaattcggtccgtaactccggtacccttaaagttacgggtatcgggaacggttcggtaggggacccgaagggcccgacacggtaccacccggtcctccctacgaacgccctaacgaaacccgacgggtccccaggttccccggtccccttccccgttggccccgtccccgtgccctccggagggcctcccgccgtaaccggg

SEQ ID NO: 361694 - DNA, 644 bp, Homo sapiens
  misc_feature: GZ8MTXP01BVWAT.21.70.G04.1.454.CMB.2.raw
  modified_base (283)..(283): a, c, t, g, unknown or other
  modified_base (290)..(290): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgtagtatttttcatgatgggaccacctactataggtcgtcgctcaacagtcgagtcaccatatccgtagacacgtcaggaaccagtctccctgaacgctgaactcnctgaccnccgcagacgcggtatatattatgtgcgagacatagtgtattcgctactcgcccttataggtatggacgtcgtcggggccgaaagggcccgcacgtcaacccgttctcccgtacacgccctacccgaaccgaacgggacccctacgtccggttcccttcccccgtggccccgcctacgcccgtccggacggtaccgaccaccccgtccgagacgaccaacgtacggccccgggccccgtcgggcctaaccggtccgttacgggttaacccgaagggtaacccttaacccggttacccgacgggaccgtaacccggcgtcggacgggtccggggccgtaacggggccaaacggggg

SEQ ID NO: 361695 - DNA, 512 bp, Homo sapiens
  misc_feature: GZ8MTXP02GCQ1J.21.70.G04.1.454.CMB.2.raw
  modified_base (258)..(258): a, c, t, g, unknown or other
  modified_base (372)..(372): a, c, t, g, unknown or other
  modified_base (418)..(418): a, c, t, g, unknown or other
  modified_base (422)..(422): a, c, t, g, unknown or other
  modified_base (433)..(433): a, c, t, g, unknown or other
tcagtcgtcgctcgcacgaccggtgctcgatttagtgtagtgtgaaggaaaggtctccgaagccttcggagaccctgtccctcacctgcactgtctctggtggctccatcatcaatggtcattatcactgggctggatccgccagccccaggagggctggagtggttgcgagtattttcatgatgggaccacctactataggtcgtcgctcaacagtcgagtcaccagtatccgtagacacgtccaggaaccagttcnccctgaagctgaactctctgaccgccgcagacgcgggtatatatatgtgcgagacatagtggtattggctactcgccccctattacggatggactctggggccaaaggggaccncagtccaccgtctcctcagcctccacaaggcccatcggtctccccngccncctgctccagncacctccgagagcacagcgccctgggctgcctggtcaggactacgtcccgagcgaacgactgacgcggcctggcaacgg

SEQ ID NO: 361696 - DNA, 545 bp, Homo sapiens
  misc_feature: GZ8MTXP02I3HA0.21.70.G04.1.454.CMB.2.raw
  modified_base (525)..(525): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctgggagtgggttgcgagttattttcatgatgggaccactactataggtcgtcgctcaacagtcgagtcaccatatccgtagacacgtccaaggaaccagttctccctgaagctagaactctctcgaccgccgcagacgcgggtatatattattgtgcgagacatagtgtattggctactcgcctattacggtatggacgtcgtggggccaaaggggaccgcgacgtccgaccgtctcctcacgcctccaccaacgggccccacgtccggtccttcccccgtggccgccctcgcctccgaaggcnccaccgcgacgacgcaaccg

SEQ ID NO: 361697 - DNA, 552 bp, Homo sapiens
  misc_feature: GZ8MTXP02FSD7V.21.70.G04.1.454.CMB.2.raw
  modified_base (377)..(377): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgccccctatacgtatggactcgtggggccaagggccgnagtcacgtctcctcagccctccaccaacgggcccactccggtccttcccccgtggcccgccctcgcctcccgaggacgccaccctccgacgagcacgagccgcccgtggggcctcgccctggtcaaaggactaccgttcccgagccgaacgctacgacgcgggctcggcaacggg

SEQ ID NO: 361698 - DNA, 542 bp, Homo sapiens
  misc_feature: GZ8MTXP02FTITJ.21.70.G04.1.454.CMB.2.raw
  modified_base (419)..(419): a, c, t, g, unknown or other
  modified_base (451)..(451): a, c, t, g, unknown or other
  modified_base (463)..(463): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaacccagttctccctgaagctgaactctctgaccgccgcagacgcgggtatatatttatgtgcgagacatagtggtattggctactcgccccctattacggatggacgtctggggccaaggggaccgcagtcaccgtctccctcagccctcaccagggcccanccggtcttcccctggccgccctgctccaggancacctccgagancacagcggccctgggctcgcctggtcaaggacctacgttccccgagtccgaacgactcggacgcgggctcggcgaacgg

SEQ ID NO: 361699 - DNA, 609 bp, Homo sapiens
  misc_feature: GZ8MTXP02JEOJ8.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccagggaagggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgccccctattacggtatggacgtctggggccaaggggccgcagtcaccgtctcctcagccctccaccaacgggcccactccggtccttccccctggcccgccccgtcgccgtccgacgggtacgcccacccgtaccgacggacgccaacgacggcccgggtcccgtcggggcctcggcccgttacgggtaccgaaacggtaccttacccgttaccccggagtacccggaacgtaccgtacggacggccggggtcgtacgggacaaacgggg

SEQ ID NO: 361700 - DNA, 577 bp, Homo sapiens
  misc_feature: GZ8MTXP02FSJ84.21.70.G04.1.454.CMB.2.raw
  modified_base (380)..(380): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaacccagttctccctgaagctgaactctctgaccgccgcagacgcggtatatatttatgtgcgagacatagtggtattggctactcgccccttattacggatggacgtcgtggggccaagggccncgagtccaccgtctcctcacgccctccaccgaacgggcccacgtccgtccttcccccgtcggccgccccgtcgcctccgaggacgccaccctccgacgacgcacgacgccggcccgtcgggctcgccgtggtaccaacggtactaccgttacccgacgccgaaccgacgtacggacggcgggcgtacgggcgaacgg

SEQ ID NO: 361701 - DNA, 576 bp, Homo sapiens
  misc_feature: GZ8MTXP02GFQEB.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgcccctatacgtatggacgtctggggccaagggccgcagtcaccgtctcctcacgcctccaccaacggcccactccggtccttccccctcggccgcccctcgcctccgacggacgccgaccctccgaacgacgcgacgacggccggcccgtcgggcctcggcccgtggtccgaacggacctaccgttacccgacgaccgaaccgaacgtcggacggcgggcgtcgggacgaacggg

SEQ ID NO: 361702 - DNA, 588 bp, Homo sapiens
  misc_feature: GZ8MTXP02H811A.21.70.G04.1.454.CMB.2.raw
  modified_base (264)..(264): a, c, t, g, unknown or other
  modified_base (384)..(384): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccactactataggtcgtcgctcaacagtcgagtcaccatatccgtagacacgtccaggaaccagttcnccctgaagctgaactctctgacccgcgcagacgcgggtatatatttatgtgcgagacatagtggtatggctactcgcccctattacggtatggacgttcgcggggccaaagggggacccncgtagtccaccgtctcctcacgccctacccaaccgaacggccctacgtccgttcccttcccccgtcggcccgcccgtcgcctaccgacggacgccgacccgaccgacgacgcacgacggccggccgtcgggcgtcgccgtacggtacgaaacggacctaccgtccgacgaccgaacgacgacggacggcggcgacggacgacgg

SEQ ID NO: 361703 - DNA, 586 bp, Homo sapiens
  misc_feature: GZ8MTXP02GP32N.21.70.G04.1.454.CMB.2.raw
  modified_base (381)..(381): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgacccgccgcagacgcgggtatatattatgtgcgagacatagtggtatggctactcgcccctatacggtatggacgtcgtggggccaaaggggccncgagtccacccgtctccctcacgccctccacccgaacgggccccagtcccggtccttcccccgtgggcccgcccctcgccctccgacggacgccacccgtccgacgacgccacgacgccggcccgtggacctcggccgtggtacgaaacggaccttaccgtcccgacgccgaacgacgtcggacggcgggacgtcggacaacggg

SEQ ID NO: 361704 - DNA, 538 bp, Homo sapiens
  misc_feature: GZ8MTXP02JS8NF.21.70.G04.1.454.CMB.2.raw
  modified_base (490)..(490): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccactactataggtcgtcgctcaacagtcgagtcaccatatccgtagacacgtccaggaaccagttctccctgaagctgaactctctcgaccgccgcagacgcgggtatatattattgtgcgagacatagtggtattggctactcgccctattacggtatggacgtcgtggggccaaggggaccgcagtcaccgtctcctcacgcctccaccagggcccagtccggtccttcccccgnggccgccctcgcctcccgaaggacgccacctccgagacggacaaccgg

SEQ ID NO: 361705 - DNA, 539 bp, Homo sapiens
  misc_feature: GZ8MTXP02G66L6.21.70.G04.1.454.CMB.2.raw
  modified_base (314)..(314): a, c, t, g, unknown or other
  modified_base (448)..(448): a, c, t, g, unknown or other
  modified_base (464)..(464): a, c, t, g, unknown or other
  modified_base (471)..(471): a, c, t, g, unknown or other
  modified_base (505)..(505): a, c, t, g, unknown or other
  modified_base (507)..(507): a, c, t, g, unknown or other
  modified_base (509)..(509): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagccccagggaagggctggagtgggttgcgagtattttcatgatggaccactactataggtcgtcgctcaacagtcgagtcacatatccgtagacacgtcagaaccagttcnccctgaagctagaactctctcgacccgccgcagacgcggtaatattattaattgtagcgaagacataagtggtaattggctaacgtcgacccttaatacggtaatgggactcgtagggggccaaagggacccgnacgtccaccgtctccncacgccnccaccacgaccgactcgtcctccctccgccgccncncnccgaacgacgacaccaccgacgacgacacg

SEQ ID NO: 361706 - DNA, 558 bp, Homo sapiens
  misc_feature: GZ8MTXP02G0SAS.21.70.G04.1.454.CMB.2.raw
  modified_base (315)..(315): a, c, t, g, unknown or other
  modified_base (441)..(441): a, c, t, g, unknown or other
  modified_base (509)..(509): a, c, t, g, unknown or other
tcagtcgtcgctcgcacgaccggtgctcgatttagtgtagtgtgaagggaaagggtctccgaaggcttcaccagtcctgtctcagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccactactataggtcgtcgctcaacagtcgagtcaccatatccgtagacacgtccaggaaccngttcctccctgaagctagaactctcctcgacccgcgcagacgcgggtatatattattgtgcgagacatagtgtattggctactcgcccttagttacggtatggacgtcgtggggaccaaggggccncagtccaccgtctcctcacgccctccaaccgaccgggccctacgttccggtcccttccccgcggcccnccccttgcccgtaaccgaggaccgcccacccgtaccgaacggacgcccg

SEQ ID NO: 361707 - DNA, 559 bp, Homo sapiens
  misc_feature: GZ8MTXP02HM25Z.21.70.G04.1.454.CMB.2.raw
  modified_base (292)..(292): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtattttcatgatgggaccactactataggtcgtcgctcaacagtcgagtcaccatanccgtagacacgtccaggaaccagttctccctgaagctgaactctctcgaccgccgcagacgcgggtatatattattgtgcgagacatagtgtattgctactcgcctattacggtatggacgtcgtggggcctaaggggaccgacgacgtcgacccgtctccctcacgccctccaccaacgggcccaactccgggtcccttcccccgtcggcccgtccccgtcgcctcccgaacggacgcccaccctcccggacgacgaccaacccgg

SEQ ID NO: 361708 - DNA, 594 bp, Homo sapiens
  misc_feature: GZ8MTXP02IBJJ8.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatctgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtgtattggctactccgccctattacggatggacgttctgggggccaaaggggcccgcagtcaccgtctcctcacgccctccacccgaacgggccccacgtccggtcccttcccccgtcggcccgcccctcgccctcccgacggacgccaccctcccgagacgcaacgcgccggtcccgtcggggcctcggcccgtggtaccgaaacgggtacctaaccgttcccgaacgccggaaccgacgtcggacggccggggcgtacgggaccg

SEQ ID NO: 361709 - DNA, 567 bp, Homo sapiens
  misc_feature: GZ8MTXP02HJRB2.21.70.G04.1.454.CMB.2.raw
  modified_base (266)..(266): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttcnccctgaagctgaactctctgaccgccgcagacgcgggtatatattatgtgcgagacatagtgtatggctactcgccccctattacggtatggacgtcgtggggccaaagggaccgcagtccaccgtctccctcacgccctccaccgaacggccccatccggtccttcccccgtcggccgccctgcctccgacggacgcccaccgtccgagacgcacacgccggcccgtgggcctcgcccgtggtacaacgggactaccgttcccgagccgaacgctcggacggcgggctcgggacaacggg

SEQ ID NO: 361710 - DNA, 619 bp, Homo sapiens
  misc_feature: GZ8MTXP02IDYWH.21.70.G04.1.454.CMB.2.raw
  modified_base (330)..(330): a, c, t, g, unknown or other
  modified_base (349)..(349): a, c, t, g, unknown or other
  modified_base (371)..(371): a, c, t, g, unknown or other
  modified_base (404)..(404): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggccccaggactggtgaagcccttcggagaccctgtcccctcacctgcactgtctctggtgctccatcatcaatggtcattatcacgtggggctggatccgccacgcccccgagggaaggggctgggagtgggtgcgtagttatttttcatgagtgggaccacctactataggtcgtcgctcaacagtcgagtcaccatatccgtagacacgtccaggaccagttcnccctgaagctgaactctcncgaccgccgcagacgcggtatntattatgtgcgagactatagtgtattggctacncgcccttattacggtatggacgtcgtacggggccaaaggggccgtcgacggtccgaacccggttcctcccgttacacgccccttacccgaacccgaaacggggccccctaagtccccgggttccccttccccccgtcggggcccctcccccgtcggcccttacccggaacggggacctacccgaccccgtcccggaacgaacgcccgaaaccggg

SEQ ID NO: 361711 - DNA, 563 bp, Homo sapiens
  misc_feature: GZ8MTXP02I2PU7.21.70.G04.1.454.CMB.2.raw
  modified_base (329)..(329): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaaggggctgggagtgggttgcgtagttattttcatgatgggaccacctactataggtcgtcgctcaacagtcgagtcaccatatcgtagacacgtccaggacagtctccctganctagaactctctcgacccgcgcagacgacgggtatagtattattgtgcgagacatagtgtattgctactcgccttagttacggtatcggacgtcgtacggggccgtaacgggaccgacgacgtcaccgtcctacctcacgcctccaccgaacggcccacgtccgtccttcccccgtcggccgtccccgtcgcctaccgaacggaacgccgacccgtccgacgacgacaacccgg

SEQ ID NO: 361712 - DNA, 553 bp, Homo sapiens
  misc_feature: GZ8MTXP02G53ZJ.21.70.G04.1.454.CMB.2.raw
  modified_base (545)..(545): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgacccgccgcagacgcgggtatatattatgtgcgagacatagtggtatggctactcgccccctattacggtatggacgtcgtggggccaaggggaccgcagtccacgtctcctcacgccctccaccgaagggcccatccggtccttcccccgtcggccgcccgtgcctccacggacgccacctccgagacgcacacgccggcccgtgggcctcgccctggtcaacggacctacgttcccgagcgaacgactgacgcggcnggacacgg

SEQ ID NO: 361713 - DNA, 560 bp, Homo sapiens
  misc_feature: GZ8MTXP02J1ZFD.21.70.G04.1.454.CMB.2.raw
  modified_base (242)..(242): a, c, t, g, unknown or other
  modified_base (282)..(282): a, c, t, g, unknown or other
  modified_base (373)..(373): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatctgccagcccccagggaagggctggagtgggttgcgagtattttcatgatggaccacctactataggtcgtcgctcaacagtcgagtcaccatatccgtanacacgtccaggaaccagttctccctgaagctgaactctcngaccgcgcagacgcggtatatattatgtgcgagacatagtgtatggctactccgcctagtacggtatggacgtgtgggggccaaggggccnagtccaccgtctcctcacgccctaccacccgaacgggccccagtccggttcccttccccccgtggcccgtcccctcgcctccgacggacgaccgaccctccgacgacgcaccgacgccggcccgtggccgtcgccgtcggtacgacggactaccgtccgagccgacgacgcggacgcggctcggacg

SEQ ID NO: 361714 - DNA, 548 bp, Homo sapiens
  misc_feature: GZ8MTXP02GYPOI.21.70.G04.1.454.CMB.2.raw
  modified_base (367)..(367): a, c, t, g, unknown or other
  modified_base (508)..(508): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagttattttcatgatggggaccacctactataggtcgtcgctcaacagtcgagtcaccatatccgtagacacgtccaggaaccagttctccctgaagctgaactctctcgaccgccgcngacgcgggtatatattattgtgcgagacatagtgtattgctactcgcctattacgtatggacgtcgtggggccaagggaccgcgagtcaccgtctcctcacgccctccaccgaacgggcccaacgtccggtccttcccccnggcccgcccgtcgccgtcccacggacgccaaccgtcccgg

SEQ ID NO: 361715 - DNA, 587 bp, Homo sapiens
  misc_feature: GZ8MTXP02F6AXX.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatggaccacctactataggtcgtcgctcaacagtcgagtcaccatatccgtagacacgtccaggaaccagttcctccctgaagctgaactctctgaccgccgcagacgcgggtatatattatgtgcgagacatagtgtatggctactcgcccctattacgtatggacgtcgtgggccaagggccgcacgtcaccgtctccctcacgccctccaccgaacggcccaagtcccggtccttcccccgtggcccgccccgtcgcctccgacggacgccacccgtccgaacgacgcacgacgccggcccgtcggggcctcggccgtcggtaccgaaacggtaccttaccgttaccccggagaccgaacgtacgtacggacggcgggtcgcggaccgaacggg

SEQ ID NO: 361716 - DNA, 556 bp, Homo sapiens
  misc_feature: GZ8MTXP02H2IPQ.21.70.G04.1.454.CMB.2.raw
  modified_base (256)..(256): a, c, t, g, unknown or other
  modified_base (291)..(291): a, c, t, g, unknown or other
  modified_base (366)..(366): a, c, t, g, unknown or other
  modified_base (427)..(427): a, c, t, g, unknown or other
  modified_base (480)..(480): a, c, t, g, unknown or other
  modified_base (536)..(536): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagccccagggaagggctggagtggtgcgagtattttcatgatggacactactataggtctcgctcaacagtcgagtcaccatatccgtagacacgtccaggaacagttcnccctgaagctagaactctctgaccgccgcagacgnggtatatatatgtgcgagacatagtgattggctactcgcccctatacggtatggactcgtgggccaaaggggccncgagtccaccgtctcctcacgcctaccacccgaaacgggcccacgtccggtccttcccccnggccgccctcgcctccaggacgccaccgccgagacgccgacggcggtccccgngggcctcgcccgttggaccaaacggtacctaaccgtccccgagccgaacgaaccgngacggcggcgcggcaaggcg

SEQ ID NO: 361717 - DNA, 562 bp, Homo sapiens
  misc_feature: GZ8MTXP02GVDW8.21.70.G04.1.454.CMB.2.raw
  modified_base (376)..(376): a, c, t, g, unknown or other
  modified_base (388)..(388): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattatgtgcgagacatagtggtattgctactcgcccctattacgtatggacgtcgtggggccaagggccncagtccacgtcncctcagccctccaccaacgggcccacgtccggtcccttcccccgtcggccgcccctgcctccgaggacgccacccgtcccgaagacgccacgacgccggcccgtgggctcgccgtggtaccaaggacctacgttccccgagccgaacgaccgtggacggcggctcgggcaacgg

SEQ ID NO: 361718 - DNA, 525 bp, Homo sapiens
  misc_feature: GZ8MTXP02GTB0E.21.70.G04.1.454.CMB.2.raw
  modified_base (373)..(373): a, c, t, g, unknown or other
  modified_base (448)..(448): a, c, t, g, unknown or other
  modified_base (479)..(479): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccacgccccagggaagggctggagtgggttgcgagttatttttcatgatgggaccactactatagtcgtcgctcacagtcgagtcaccatatccgtagacacgtccacggaaccacgtctccctgaagctgaactctctcgaccgccgcacgacgcggtatatattattgtgngagacatagtgtattgcgtactcgcctagttagtatggacgtcgtggggcaaagggccgcagtcaccgtctctcngcctccacacggccactcgtccttcccccgngtccgaccctcgcctccgaaggacgccaccctcgacgacgccaacg

SEQ ID NO: 361719 - DNA, 637 bp, Homo sapiens
  misc_feature: GZ8MTXP02HW0AX.21.70.G04.1.454.CMB.2.raw
  modified_base (365)..(365): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccacgccccagggaagggctggagtgggttgcgtagtatttttcatgatggaccactactataggtctcgctcaacagtcgagtcaccatatccgtagacacgtccaaggaaccagttcctccctgaagctagaactctctcgacccgccgcagacgcgggtatntattattgtgcgagactagtagtgtaattggctactcgtacccttagttaccggtatcgggtacgtacgttcggggacccgtaaaggggaccccggacgtaacggtcccgtaacccggtccttacccgttaccgaacggcccccttaccccgaaacccgaaaaccggggccccctaacgtccccggtttcccgttccccccgtcggccccgtccccgtcgtccctccccgaaggaccgacccgtacccgtaccggacgacgacccaacccgg

SEQ ID NO: 361720 - DNA, 539 bp, Homo sapiens
  misc_feature: GZ8MTXP02HQP3C.21.70.G04.1.454.CMB.2.raw
  modified_base (320)..(320): a, c, t, g, unknown or other
  modified_base (361)..(361): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccactactataggtcgtcgctcaacagtcgagtcaccatatccgtagacacgtccaggaaccagttcnccctgaagctgaactctctgaccgccgcagacgcgggtatntattatgtgcgagacatagtgtattggctactcgccctattacggtatggacgtctggggccaagggaccgcagtcaccgtctcctcagcctccaccaaagggccccactccgggtccttcccccgtggccgccccgtcgccctccgaacggacgccacccgtccgacgacgcaaccg

SEQ ID NO: 361721 - DNA, 569 bp, Homo sapiens
  misc_feature: GZ8MTXP02J27Y8.21.70.G04.1.454.CMB.2.raw
  modified_base (315)..(315): a, c, t, g, unknown or other
  modified_base (384)..(384): a, c, t, g, unknown or other
  modified_base (466)..(466): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgngcgagcatagtggtattggctactcgccccctattacggtatggacgtcgtggggcccaaaggggcccncagtcacccgttctccctcacgactcccaccgaaacggggcccagtccggtcttcccccgtggccgccctgcctccgaggcncaccctccgagacgcacacggccggccctggggctcgcctggtcaacggacctaccgttccccgaagccgaaccgtacgcggacggccggcgtcggacgacgg

SEQ ID NO: 361722 - DNA, 577 bp, Homo sapiens
  misc_feature: GZ8MTXP02H1YU3.21.70.G04.1.454.CMB.2.raw
  modified_base (364)..(364): a, c, t, g, unknown or other
  modified_base (374)..(374): a, c, t, g, unknown or other
  modified_base (473)..(473): a, c, t, g, unknown or other
  modified_base (565)..(565): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtcgaagccttcggagaccctgtccctcacctgcactgtctctggtggctccatcatcaatggtcattatcacgtggggctggatccgccacgccccgagggaagggctggaggtgggttgcgtagttatttttcatgatgggaccacctactataggtcgtcgctacaacagtcgagtcaccatatccgtaagacacgtccaaggacctagttctcctagaagctcgaactctcncgaccgcgcngacgacggtatagtattatgtgacgagactatagtggtattggcttactccgacccttattacggtagtggtacgtcggtaggggaccgaaggggaccncgacggtcctaccgtctcctcacgtcctaccaaccgaacgggcccacgtccggttcccttcccccgcggccctcccgtcgcctaccgaggcnccgaacctccgg

SEQ ID NO: 361723 - DNA, 543 bp, Homo sapiens
  misc_feature: GZ8MTXP02JENU0.21.70.G04.1.454.CMB.2.raw
  modified_base (313)..(313): a, c, t, g, unknown or other
  modified_base (468)..(468): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtanacacgtccaggaaccagttctccctgaagctgaactctctgaccgccgcagacgcgggtatatattattgtgcgagacatagtgtattggctactcgccctattacggtatggacgtcgtggggcctaagggaccgcgagtccaccgtctcctcncgccctccaccgacgggcccagtccggtccttcccccgtggcccgcccgtcgcctccaggacgccgacctcccgg

SEQ ID NO: 361724 - DNA, 563 bp, Homo sapiens
  misc_feature: GZ8MTXP02FQROF.21.70.G04.1.454.CMB.2.raw
  modified_base (382)..(382): a, c, t, g, unknown or other
  modified_base (476)..(476): a, c, t, g, unknown or other
  modified_base (501)..(501): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattatgtgcgagacatagtggtattggctactcgccccctattacggtatggacgtcgtggggccaaggggaccncgaagtcaccgtctcctcacgccctccaccaacggcccagtccgtccttcccccgtgcccgccctcgcctccgacggcgaccaccctccgacgngcacacgccggccctgggctcgccnggtacgaacggtactaccgttcccgacgacgaacgacgtcggacgcggcgtcggacgaacgg

SEQ ID NO: 361725 - DNA, 548 bp, Homo sapiens
  misc_feature: GZ8MTXP02GPIHC.21.70.G04.1.454.CMB.2.raw
  modified_base (363)..(363): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtagacacgtccaggaaccagttctccctgaagctagaactctctgaccgcgcagacgcgggtatntattatgtgcgagacatagtgtatggctactcgcctattacggtatggacgtcgtggggccaagggaccgcacgtcaccgtctcctcacgcctccaccacgggccccacgtccggtccttcccccgtcggcccgcccctcgcccttcccgaagggacgaccgacccgtccgacgacgacaaccgg

SEQ ID NO: 361726 - DNA, 563 bp, Homo sapiens
  misc_feature: GZ8MTXP02IN7J0.21.70.G04.1.454.CMB.2.raw
  modified_base (334)..(334): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggatccgccacgccccgagggaagggctgggagtgggttgcgtagttattttcatgagtgggaccactactataggtcgtcgctcaacagtcgagtcaccatatccgtagacacgtccaaggaccagttctccctgaanctgaactctctcgaccgccgcacgacgcggtatatattatgtgcgagacatagtgtattgctactcgtacccttattaacggtagtggacgtcgtagggggaccaaaggggaccgtcgacgtccgacccgtcctccctcacgcctccaccgaacggcccacgtccggtcccttccccctggcccgccctcgcctccgaacggacgccaccctccgacgacgccgaaccg

SEQ ID NO: 361727 - DNA, 539 bp, Homo sapiens
  misc_feature: GZ8MTXP02JHF6D.21.70.G04.1.454.CMB.2.raw
  modified_base (297)..(297): a, c, t, g, unknown or other
  modified_base (368)..(368): a, c, t, g, unknown or other
  modified_base (372)..(372): a, c, t, g, unknown or other
  modified_base (430)..(430): a, c, t, g, unknown or other
  modified_base (454)..(454): a, c, t, g, unknown or other
  modified_base (514)..(514): a, c, t, g, unknown or other
  modified_base (520)..(520): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccagcccccgagggaaggggctgggagtgggttgcgtagttatttttcatgagtggaccactactataggtcgtcgctcaacngtcgagtcaccatatccgtagacacgtccaaggaccagttcctccctgaaacgctcgaactctctgacccncgcngacgacggtatatattatgtgacgagacatagtgtattgctactcgacctatcggtanggacgtcgtgggccaagggtaccngacgcacccgtctccgtcacgccctaccaccgaaggcccagtccggtcctccccgtgccncccgtncctcaggcaccgacctacg

SEQ ID NO: 361728 - DNA, 574 bp, Homo sapiens
  misc_feature: GZ8MTXP02HTNEU.21.70.G04.1.454.CMB.2.raw
  modified_base (263)..(263): a, c, t, g, unknown or other
  modified_base (311)..(311): a, c, t, g, unknown or other
  modified_base (375)..(375): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatggaccactactataggtcgtcgctcaacagtcgagtcaccatatccgtagacacgtccaggaaccagttcnccctgaagctgaactctctgaccgccgcagacgcggtatatattatgngcgagacatagtgtatggctactcgcccctatacgtatggacgtcgtggggccaaaggggcccnagtccaacccgtctccctcacgccctcccaacccgaaacggggccccagtcccgggtcccttccccccgtgggcccgcccctgcctccgaggacgccacccgtccgagacgcacgacggccggcccgtggggcctcggccctggtaccaaaggacctaccgtccccgagccgaacgactgacgcgggctcggacaacgg

SEQ ID NO: 361729 - DNA, 622 bp, Homo sapiens
  misc_feature: GZ8MTXP02GPI3O.21.70.G04.1.454.CMB.2.raw
  modified_base (257)..(257): a, c, t, g, unknown or other
  modified_base (338)..(338): a, c, t, g, unknown or other
  modified_base (357)..(357): a, c, t, g, unknown or other
  modified_base (406)..(406): a, c, t, g, unknown or other
  modified_base (588)..(588): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccacgccccagggaagggctggagtgggttgcgagttattttnatgatgggaccacctactataggtcgtcgctcaacagtcgagtcaccatatccgtagacacgtccaaggaacccagttccncctgaaagctgaaacttcnctcgaccgccgacaggccgacgggttaataacttatttaatgtgacganaactagtagtggttaagttggaccttaacgtccgtacccttaagttaaccgggttaattcgggacggttcggtcgggggaccgaaacgggggaccgacgacggtacctaacccggtccttccacgaccgccctacccgaaccgaaacgggccccagttcccggtccttcccccgcggccccnccgttccgcctaccggacgaccgccaaccgccgg

SEQ ID NO: 361730 - DNA, 602 bp, Homo sapiens
  misc_feature: GZ8MTXP02HUKX2.21.70.G04.1.454.CMB.2.raw
  modified_base (361)..(361): a, c, t, g, unknown or other
  modified_base (375)..(375): a, c, t, g, unknown or other
  modified_base (442)..(442): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctggagtgggttgcgagtatttttcatgatgggaccacctactataggtcgtcgctcaacagtcgagtcaccatatccgtagacacgtccaggaaccagttctccctgaagctgaactctctcgaccgccgcagacgcggtatatattatgtgcgagacatagtgtatgctactcgcccctatacgtatggactcgnggggccaagggccnacgtccaccgtctccctcacgccctaccaaccgaacgggcccctacgtcccggttcccttcccccgngggcccgccccgttcgccccgttccgacgggacgtacccaccccgtccgaacgacgaccaacgacggcccggcccgtcgggcctcggccgttcggacgaacggtacctaccgttcccgagccggaacgtacgtcggacggcgggacgtcggacgaacggg

SEQ ID NO: 361731 - DNA, 586 bp, Homo sapiens
  misc_feature: GZ8MTXP02I5PR3.21.70.G04.1.454.CMB.2.raw
  modified_base (293)..(293): a, c, t, g, unknown or other
  modified_base (321)..(321): a, c, t, g, unknown or other
  modified_base (326)..(326): a, c, t, g, unknown or other
  modified_base (476)..(476): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttcctccctgaagctgaaactctctcgaccnccgcagaccgcgggtatattattattgngcganacatagtggtattggctactcgccccctattacggatcggtacgtcgtggggccaaggggccacagttccaccgtctccctcacgccctaccaccgacgggccctatccggtccttcccccgtcggcccgccctcgccttccgacggacnccacccgtccgaacgacgcgacgacgccggcccgcgggctacgccgtggcgtaaacgccttaccgtacccggagaccgaacgacgtcggacgccggcgtcggacgaacgg

SEQ ID NO: 361732 - DNA, 572 bp, Homo sapiens
  misc_feature: GZ8MTXP02G09BK.21.70.G04.1.454.CMB.2.raw
  modified_base (380)..(380): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgcccctattacggtatggacgtctggggccaaggggccncagtccaccgtctccctcacgccctccaccgaacgggccccagtccgggtccttccccccgtgggcccgcccctgcctccgaggacgccacccgtccgacgacggccacgacgccggcccgtgggcctcgccctggtcaaacgggactaccgttacccgagccgaacgctacggaggcgggctggcgaacgg

SEQ ID NO: 361733 - DNA, 583 bp, Homo sapiens
  misc_feature: GZ8MTXP02JKDO7.21.70.G04.1.454.CMB.2.raw
  modified_base (469)..(469): a, c, t, g, unknown or other
tcagtcgtcgctcgcacgaccggtgctcgatttagtgtagtgtgaagggaaagggtctccgaagccttcggagaccctgtacctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtgtattggctactcgccccctattacggtatggacgtctggggccaaggggaccgcgacgtcacccggtctccctacacgccctcccaccaacgggccccatccggtccttcccccgtgggccgccctgcctcccgagggacncacccgtccgagacgccacacggccggccccgttgggccttcggcccgtggtaccaaacgggtctaccgttcccggacgccgaacgactcggacggcggcgtcggcgaaacggg

SEQ ID NO: 361734 - DNA, 547 bp, Homo sapiens
  misc_feature: GZ8MTXP02IZTEL.21.70.G04.1.454.CMB.2.raw
  modified_base (243)..(243): a, c, t, g, unknown or other
  modified_base (376)..(376): a, c, t, g, unknown or other
  modified_base (424)..(424): a, c, t, g, unknown or other
  modified_base (428)..(428): a, c, t, g, unknown or other
  modified_base (457)..(457): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtanacacgtccaggaaccagttctccctgaagctgaactctctgaccgccgcagacgcgggtatatattattgtgcgagacatagtggtattggctactcgcccctatacgtatggacgtctggggccaagggccncgagtccaccgtctcctcagcctccaccaggcccatccgtcctccccngccnccctgcctccaggcgccaccgtccgacgngaccacgacgccgccgtgggctcgccgtggtcaaacggtacctaccgtcccgagccgaacgacgtcgacggcggactcgggacaacgggg

SEQ ID NO: 361735 - DNA, 593 bp, Homo sapiens
  misc_feature: GZ8MTXP02FRJFM.21.70.G04.1.454.CMB.2.raw
  modified_base (379)..(379): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcggtatatattatgtgcgagacatagtggtattgctactcgccccctattacgatggacgtcgtggggccaaggggccncagtccaccgtctccctcacgccctccaaccaacgggccccacgtcccggttcccttccccccgtcgggcccgcccctcgcctcccgacggacgccacccgtccgacgacgccacgacgccggcccgtgggcctcgcccgtggtacgaaacggaccttaccgttacccgacgaccggaaccgacgtcggacggcgggacgtcgggacgaacggg

SEQ ID NO: 361736 - DNA, 548 bp, Homo sapiens
  misc_feature: GZ8MTXP02F20P4.21.70.G04.1.454.CMB.2.raw
  modified_base (391)..(391): a, c, t, g, unknown or other
  modified_base (430)..(430): a, c, t, g, unknown or other
  modified_base (442)..(442): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtcattatcactggggctggatccgccacgccccagggaagggctggagtgggtgcgagtattttcatgatgggaccactactataggtcgtcgctcaacagtcgagtcaccatatccgtagacacgtccaggaaccagttcctccctgaaacgctagaactctctgacccgccgcagacgcgggtatatattatgtgcganacatagtgtatggctactcgcctatcgtatggacgtcgngggcaagggccncagtcaccgtctcctcacgccctaccaccgaacgggccctacggggtccttccgttcccccgtggtcccgcccgttcgccctaccgacggacgccaccgtacccgg

SEQ ID NO: 361737 - DNA, 618 bp, Homo sapiens
  misc_feature: GZ8MTXP02JKO4K.21.70.G04.1.454.CMB.2.raw
  modified_base (266)..(266): a, c, t, g, unknown or other
  modified_base (386)..(386): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttcnccctgaacgctcgaactctctgaccgccgcagacgcggtatattattatgtgcgagactataggtggtattggctactcgaccccctattacggatggacgtcgcggggccaaggggccncgacgtccaccgtctccctcacgtccctaccaccgaacgggccctacgtcccggtacccttcccccgtcggcccgtcccgtcgccctaccgacgggacgaccctacccgtccggaacgacgaccgaccgacggcccggcccgtcgggcctcgccgtcggtacgaacgggaccttaccgttaccccggagtaccgaaccggacgtcggacggccggacggtcggacgaacggg

SEQ ID NO: 361738 - DNA, 593 bp, Homo sapiens
  misc_feature: GZ8MTXP02HVX5B.21.70.G04.1.454.CMB.2.raw
  modified_base (248)..(248): a, c, t, g, unknown or other
  modified_base (264)..(264): a, c, t, g, unknown or other
  modified_base (270)..(270): a, c, t, g, unknown or other
  modified_base (320)..(320): a, c, t, g, unknown or other
  modified_base (324)..(324): a, c, t, g, unknown or other
  modified_base (390)..(390): a, c, t, g, unknown or other
  modified_base (407)..(407): a, c, t, g, unknown or other
  modified_base (454)..(454): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccacgcccccgaggggaaggggctgggagtgggttgcgtagttatttttcatgatggaccactactataggtctcgctcaacagtcgagtcaccatatccgtanacacgtccaggaaccngttccnccctagaagctagaactctctcgaccgcgcagacgcggtatatattatgncganacatagtgtattgctactcgcccccttagttaccggtatcggacgtcgtcggggccaaaggggccncacgtccaccgtctccncacgccctaccaccgaacgggcccacgttcccggtcccttcccccgngcccgtccctcgccctccgacggtacacccgacccgtccgagacgccgaccgggccgcccgtggctcgcctacggacaaacggtacctaccgtcccgacgacccgacgaacgtggacggcgggcgtcggacgaacggcg

SEQ ID NO: 361739 - DNA, 597 bp, Homo sapiens
  misc_feature: GZ8MTXP02G4HEM.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaaggggctgggagtgggttgcggagttatttttcatgatgggaccactactataggtcgtcgctcaacagtcgagtcaccatatccgtagacacgtccaggaaccagttctccctgaagctagaacctctctcgaccgccgacagacgcgggttatagtacttattgtgcgtagacatagtgtattgctactcgtaccctagttacggtatcgggtacgtcgtacgggggacctaaagggggacccgcgacgtccgacccggttcctcccgttcaacgtccctacccgaccgaacgggcccctacgtcccggtcccttcccccgtggccctccccgtacgcccgtaccgaacggacgccacccgtaccgacgacgacaaccg

SEQ ID NO: 361740 - DNA, 538 bp, Homo sapiens
  misc_feature: GZ8MTXP02IKQ4R.21.70.G04.1.454.CMB.2.raw
  modified_base (516)..(516): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtatttttcatgatgggaccactactataggtcgtcgctcaacagtcgagtcaccatatccgtagacacgtccaggaaccagttctccctgaagctgaactctctcgaccgccgcagacgcggtatagtattatgtgcgagacatagtgattggctactcgaccctattacgtatggacgtcgtaggggccaaaggggaccgcgagtccaccgtctcctcacgccctccaccgacgggcccactccggtcctcccctggccgccctcgcctccgaaggacnccaccgtccgacgacgacaccg

SEQ ID NO: 361741 - DNA, 611 bp, Homo sapiens
  misc_feature: GZ8MTXP02GFY62.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagccccagggaaggggctggagtgggttgcgagttatttttcatgatgggaccactactataggtcgtcgctcaacagtcgagtcacatatccgtagacacgtccaggaacctagttctccctgaagctagaactctctcgaccgccgcagacggcggtatatattatgtgcgagacatagtggtattggctactcgacccctagttacggatcggacgtcgtggggccgaaagggccgacacgtccaccgtcctccctcacgtccctaccaaccgaacgggccccacgttcccgggttcccttcccccgtcggcccgtccccgttcgccctaccggaaggaccgcccaacccgtcggaacgcgaccaacgacggccggcccgtcggggctcggccgtaggtccaaacgggtacctaccgtcccgaggtaccgaacgcgtggacggcgggcgacggaccgaacgg

SEQ ID NO: 361742 - DNA, 657 bp, Homo sapiens
  misc_feature: GZ8MTXP02H5GG3.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacggcccccgaggggaacggggcgtgggaggttgggttgcgtagttatttttcatgatcgggacctactactataggtcgtcgctacaacagtcgagtcacatatccgtagacacgtacccaaggaacctacgttctccctgaacgtctagaacctctctcgacccgccgcacggacgcgggtatatatttattgtgacgagactagtgtggtattggactactccgtaccttagttacggtagtcgggtacgtcggtcggggaccgaagggggacccgtcgtacggtccgtacccggttcctaccctacgtccgaccccttaccccgaaccgtaaaacccgggtccccctaaggttccccgggttcccctttcccccgccggggtccctcccccgttcgcccgtaccgaagggacccgtacgacccccggtacgacgacgaccgaacccgg

SEQ ID NO: 361743 - DNA, 612 bp, Homo sapiens
  misc_feature: GZ8MTXP02F6EHQ.21.70.G04.1.454.CMB.2.raw
  modified_base (373)..(373): a, c, t, g, unknown or other
  modified_base (604)..(604): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgccccgagggaagggctggagtgggttgcgtagttattttcatgagtcgggaccactactataggtcgtcgctcaacagtcgagtcaccatactccgtagaccacgtaccaacggaaacctagttcctacccgtagaacggtcctagaactctctccgacccgccganacggacgcgggttaatagtattattggtgcgaagactagttagtggtattggactacgtcgtaccctagttaacggtagtcgggacgtcgtacggggaccgaaacggggacccgcgacgtaccgaacccgtcctcctcacgcctaccgaaccgacgggccctacgtcccggtcccttcccccgtcggcccgtcccgtcgcctccgaacggacgacctacccgccgacgacnctaaccgg

SEQ ID NO: 361744 - DNA, 775 bp, Homo sapiens
  misc_feature: GZ8MTXP02F26W0.21.70.G04.1.454.CMB.2.raw
  modified_base (282)..(282): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgccccgagggagggctggagtgggttgcgtagttattttcatgagtggaccactactataggtcgtcgctcaacngtcgagtcaccatatccgtagacacgtaccaaggaacctagttcctccctagaacgctagaactctctaccgacccgccgacgacggtacgaccggggttattagttaatttagttgttcgacgtaagactaagttaaggttggttaacgttgggtaccttacccgttacccgtaccctttaacggtttaaccgggttaagttcggggtaccggttacggttacggggggaaccccggtaaacgggggaaccccggtacgtaaccgggttaccccgtaacccggttcccccttcccggttaccaacccggtcccccttaaccccgaaaccccgggaaaaccgggggtccccctaaaccggtttccccgggtttacccccgtttcccccccgggttcggccccggttcccccgttcggaccccttccccggtaaacgggggcccttacccgtaaacccccggtcccggaaacggacccggacgtaaccccgggg

SEQ ID NO: 361745 - DNA, 674 bp, Homo sapiens
  misc_feature: GZ8MTXP02HXGAA.21.70.G04.1.454.CMB.2.raw
  modified_base (266)..(266): a, c, t, g, unknown or other
  modified_base (322)..(322): a, c, t, g, unknown or other
  modified_base (361)..(361): a, c, t, g, unknown or other
  modified_base (386)..(386): a, c, t, g, unknown or other
  modified_base (401)..(401): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgtagtatttttcatgatgggaccactactataggtcgtcgctcaacagtcgagtcaccatatccgtagacacgtccaggaacctagttcnccctagaagctagaactctctcgaccgccgcagacgcggtatatattatgtgcganacatagtggtatggactacgtccgcccctagttacggtntcggacgtcgtgggccgaagggccnacgtcaccgtctccncacgccctaccaccgacggccctacgtcccggttcccttcccccgtcgggacccgtcccgtacggtccctaccggaacgggtacgacccgtaacccggtcccgaaggaccgacccgaaccgaccggggccccgggtccccggttcgggggcccttacgggtcccccggttggggttaaacccgaaacgggttaacccttaacccggttcccccggaaggcccggaaaccggtacgtacgggccggaccggggtcgtacggggaccgaacgggg

SEQ ID NO: 361746 - DNA, 589 bp, Homo sapiens
  misc_feature: GZ8MTXP02GIZPY.21.70.G04.1.454.CMB.2.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgacccgccgcagacgcggtaatatattattgtgcgagacagtagtggttattggctactcgccccctaattacggtatcggacgtcgtggggccgaaagggaccgcagtccaccgtctccctcacgccctaccaaccgaaacgggccccaacgtcccggttcccttccccccgtggcccgccccgtcgcctacccgacggacgccaccgtcccgagacgcaacgacgccggcccgtggggcctcgcccgtggtaccaaagggacctaccgtcccgagccgaacgactgacgcggcgcggacgacg

SEQ ID NO: 361747 - DNA, 601 bp, Homo sapiens
  misc_feature: GZ8MTXP02GDDB4.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaagggctggagtgggtgcgagttattttcatgatgggaccactactataggtcgtcgctcaacagtcgagtcaccatatccgtagacacgtccaggaaccagttcctccctgaacgctagaactctctcgaccgccgcacgacgcggtatgtattattgtgcgagacatagtggtattggctactcgcccttagttacggtatgggtacgtcgtgggggaccaaggggacccgcgtaagtccgaccgtcctccctcgacgtccctccgacccgtaaacggggccccctaagttcccgggtccctttcccccgtgggtcccgtccccgtcggtccttcccgaaggggaccacccgtaacccgttcccgacggacgacccgaaaccgg

SEQ ID NO: 361748 - DNA, 724 bp, Homo sapiens
  misc_feature: GZ8MTXP02GCNUC.21.70.G04.1.454.CMB.2.raw
  modified_base (350)..(350): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatgtcattatcactggggctggactccgccacgccccgagggaagggctggagtgggttgcgtagttatttttcatgagtcggaccactatataggtcgtcgctacaacagtcgagtcacctatactccgtaagacaccgtaccgaacggaacctaggtttccncccgtagaaacgtctacgaaccttcctctacgacccgccgacgacgggaccggacgggttaattaacgttaatttacgtttagggtcgacgtaaagtaactagttaaggttaggttacgtttaggaccctttaacgtcccgtacccttaaagtttaccgggttagttacggggtaaccggttcgggttacgggggacccgaaacgggggtaccccgacgtaacgtaccgtacccggttccttcccgtaccgaccgcccctacccgaaacccgtaacccggggacccctaccggttcccgggttccccttccccccggtcggccccgtccccgtccgacccgtacccggaaggccctacccgaccggtaacccgg

SEQ ID NO: 361749 - DNA, 705 bp, Homo sapiens
  misc_feature: GZ8MTXP02HAME9.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtggggctggactccgccacgcccccgagggaagggctggaggtgggttgcgtagttatttttcatgagtcgggacctacctatagtaggtcgtcgactacaacagtcgagtcaccatactccgagacacgtaccaacggaacctagttcctccctagaacgtctacgtaacctctcgtaccgacccgccgcaacggtacgacgggttaatacgttaatttagttggtcgacgtaagacgtaagttaggttaggttaaacgttcggactttaaccgtcccggtaccctttaacggtttacgggttaacgttacgggtaccggttcggtaccgggggtacccgaaaacgggggtccgtaccgtacgtacccgtaacccgtccttccgtaccacgtcccctaccgaaccgaaaccggcccctaacggttccccgtcccgtttcccccgtacggcccccgtcccgtcgtaccgtcccggaacggccgacccctacccggacggaccacggacccaacccggg

SEQ ID NO: 361750 - DNA, 686 bp, Homo sapiens
  misc_feature: GZ8MTXP02GSMEH.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtggggctggactccgccacgccccgaagggagggctggagtgggttgcgtagttattttcatgagtcggaccactactataggtcgtcgctacaacagtacgacgtcaacctatacgtaccgtaagaccaccgtaccaacggtaaccctaggttccctcccttaggaactccgtagaaacctcgtactccgacccgccgacacggacggtcggtaatagttattattggtagacgagactagtagtgtattgctactcgtaccttagttacggtagtcggtacgtcggtacggggaccgaacgggaccgacgtacggtaccgtacccgttcctaccctccgacgtccccgtacccgaaaccgacccggggaccctaccggttcccccggtttcccgttcccccccgttcgggccccgtacccccgttccgacccgtacccggaacgggtacccgaccccgttaccccggaccggaacggaccggtacccaaaccccggg

SEQ ID NO: 361751 - DNA, 634 bp, Homo sapiens
  misc_feature: GZ8MTXP02JZGEN.21.70.G04.1.454.CMB.2.raw
  modified_base (323)..(323): a, c, t, g, unknown or other
tcagtcgtcgctcgcacgaccggtgctcgatttagtgtagtgtgaagggaaagggtctccgaaggcttcaccagtcctgtcccagctgcagctgcaggagtacgggcccaggactggtgaagccttcggagaccctgtccctcacctgcactgtctctggtgctccatcatcaatggtcattatcactggggctggatccgccacgcccccgagggaagggcgtgggagtgggttgcgtagttatttttcatgagtgggaccactactataggtcgtcgctcaacgagtcgagtcacatatccgtagacacgtccaggaaccngttcctccctgaacgctgaactctcgtcgaccgccgcaggacgcggttatagtattagttgtgcagacagtagtggtattggctacgtccgtacctagttacggttaagtcggacgttcggtacgggggaccgaaacggggaccgcgaacgtccgtaaccgtcctccctacgacgtcccctacccgaacccgaacggggcccctaacgttccccgggttcccttccccccggtcgggtccccgtccccgtccggtcccttacccgaacgggacccgacccgtacccgtcccggacgaccggacgaacccgg

SEQ ID NO: 361752 - DNA, 670 bp, Homo sapiens
  misc_feature: GZ8MTXP02HTBHR.21.70.G04.1.454.CMB.2.raw
  modified_base (199)..(199): a, c, t, g, unknown or other
  modified_base (254)..(254): a, c, t, g, unknown or other
  modified_base (456)..(456): a, c, t, g, unknown or other
  modified_base (666)..(666): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcatttatcacgtgggctgacnccgccaccgaccccggaggggagggcgtggtaggtgggtgacgtagtttatttangtagtgacggacctactactagtacggtcgtcgctacaacgtacgtcgacgtaccaactagttacgtaccggtaacgaccgtaccgtaccgaaaccgtaaccttaccgttcccttacccgagaacgtctaacgtactcttaccgacccgacccgccgacgacggtacggtacggttaattagttactttagtgtacgacganattagtgttagtattggaccttcgtacccgttcttaacggttacgtcgtagggtaccgtgggtaccgggaccggaaggcccgtagtacgtacccgtcctcgttaccctacgacgtcccctaaccgaaccggaccggtccctacggtccccgtttccctcccgccgacctcccgctccgtacgaacgtcacccgtaccgaggacaccgacnccgg

SEQ ID NO: 361753 - DNA, 630 bp, Homo sapiens
  misc_feature: GZ8MTXP02HIYAI.21.70.G04.1.454.CMB.2.raw
  modified_base (395)..(395): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggcggctccatcatcaatggtcattatcactggggctggatccgccacgccccagggaagggctggagtgggttgcgtagttatttttcatgatgggaccactactataggtcgtcgctacaacagtcgagtcaccatactccgtagacacgtaccaaggaacctagttcctccctagaagctagaactctctccgaccgccgcacggacgcgggtaatacgtatttattgtgacganaactatagttggtagttgcttactccgtacccttagttacggtagtcgggtacgttcgtacgggggaccgaaacggggaccgacgacgtaccgacccgtctcccgtacacgtccctacccgaaccgaacggggccccacgttcccggttccccttcccccgtcgggtccccgtccccgtcgccccgttaccgaacggtaccgacccgtacccgtaccgacgacgaccgaacccgg

SEQ ID NO: 361754 - DNA, 584 bp, Homo sapiens
  misc_feature: GZ8MTXP02ICR7W.21.70.G04.1.454.CMB.2.raw
  modified_base (358)..(358): a, c, t, g, unknown or other
  modified_base (368)..(368): a, c, t, g, unknown or other
  modified_base (381)..(381): a, c, t, g, unknown or other
  modified_base (390)..(390): a, c, t, g, unknown or other
  modified_base (482)..(482): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggccccaggactggtgaagccttcggagaccctgtccctcacctgcactgtctctggtggctccatcatcaatggtcattatcactggggctggatccgccacgcccccaggggaaggggctggaggtgggttgcgtagttatttttcatgagtgggacccacctactataggtcgtcgctcaacagtcgagtcaccatatccgtagaccacgtacccaaggaccacgttctcccctagaacgctagaactctcncgacccgccncagacgcggtatntattatgtncgagacatagtgttatgctactcgtcccttagttacggtagtgggacgtcgtaggggacccgaagggacccgcacgtccgacccgtctaccncacgccctaccgaccgacgggcccacgttccgtcccttccccgtcgggccctccgtcgcccgtaccgcggacgaccctacccgaccggacaacgccgaaccg

SEQ ID NO: 361755 - DNA, 628 bp, Homo sapiens
  misc_feature: GZ8MTXP02HDBVB.21.70.G04.1.454.CMB.2.raw
  modified_base (289)..(289): a, c, t, g, unknown or other
  modified_base (390)..(390): a, c, t, g, unknown or other
  modified_base (500)..(500): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatactccgtagacacgtccaaggaaccagttcctccctgaacgctgaactctcncgaccgcgcagacgcggtatatattatgtgcgagacatagtgtatggctactccgccccttagttacgtagtcggacgtcgtggggaccaaacggggcccncgacgtccaacccgtcctcccgtcaccgccctacccaacccgaacgggcccctacgttcccggtcccctttcccccgcggcccgtcccctacgcccgtcccgacggaccnccacccgtccgacgacgccgacgacggcccggcccgtcgggcctcggccgttcgggaccgaaacgggtacccttaaccgtcccgacggtaccgaaccgcgacggcggcgggcgtcgggaccgaacggg

SEQ ID NO: 361756 - DNA, 661 bp, Homo sapiens
  misc_feature: GZ8MTXP02J2TPF.21.70.G04.1.454.CMB.2.raw
  modified_base (375)..(375): a, c, t, g, unknown or other
  modified_base (537)..(537): a, c, t, g, unknown or other
  modified_base (649)..(649): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctcgtggtggctccatcatcaatggtcattatcacgtggggctggactcccgccacggcccccgaagggggaacggggcgtgggtaggtggggttgcggtagttattttttacagttggtaagtcgggtaaccctaaccgtaacgtagtacggttcgtcggcctacaacgtagtcgacgtaccacatatccgtagaccacgtaccgaacggtaccagttccncccgtagaacgctagaacctctccgtacccgacccgcgacgacggacggtcggttaatattaagtttcttgtgacgagtacagttagttcgtagttcggtacttacgtcccgtcgttaagtacggttgtacggtacgtcggtacggggaccgtaacgggccngtacgtccgtaccgtcctctcgacgccctaccgaccgaaccggtccaccggtcccgtccctccccgtacggccctccctacgccctacgaacggtcgaccctccgaccgganaccgacacccgg

SEQ ID NO: 361757 - DNA, 588 bp, Homo sapiens
  misc_feature: GZ8MTXP02F0RFW.21.70.G04.1.454.CMB.2.raw
  modified_base (328)..(328): a, c, t, g, unknown or other
  modified_base (361)..(361): a, c, t, g, unknown or other
  modified_base (376)..(376): a, c, t, g, unknown or other
  modified_base (390)..(390): a, c, t, g, unknown or other
  modified_base (400)..(400): a, c, t, g, unknown or other
  modified_base (421)..(421): a, c, t, g, unknown or other
  modified_base (449)..(449): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtggggctggactccgccagcccccgagggagggctggagtgggttgcgtagttattttcatgagtcgggaccactactataggtcgtacgctcaacagtcgagtcaccatatccgtagacacgtccaggaacctagttccnccctagaacgctgaactctctcgacccgccganacgacgcgggttatntattattgtgcganacatagtgtntgctctcgactagttacggtntggtacgtgtacggggaccaaggggccncgacgtaccaccgtcctcctacgcgtacccaccgaaccgaaccgggtccctacgttccggtcccccttccccggtcggcccgtccccgtcgcccttaccgaacgggacctacccgacccgcggaacgaccgcgaacccg

SEQ ID NO: 361758 - DNA, 607 bp, Homo sapiens
  misc_feature: GZ8MTXP02H5EDI.21.70.G04.1.454.CMB.2.raw
  modified_base (373)..(373): a, c, t, g, unknown or other
  modified_base (379)..(379): a, c, t, g, unknown or other
  modified_base (389)..(389): a, c, t, g, unknown or other
  modified_base (577)..(577): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggctgggagtgggttgcgtagttatttttcatgagtgggacccactactataggtcgtcgctcaacagtcgagtcaaccatatccgtagacacgtaccaggaacctagttcctccctagaagcctagtaacctctctcgacccgccgcagcgnggtatntattattgtncgagacatagtgtattgggacttacgcgtacccttagttacggtatgggtacgtcgtacgggggcctaaagggggaccctcgacgtcccgaccgtccctaccgtcgacgccctacccgaaccgaacgggccccctagtcccggttcccttcccccgtggccccgtcccgtcgtcccacgaacgggacncccgacccgtacccggacgccgacaaccgg

SEQ ID NO: 361759 - DNA, 684 bp, Homo sapiens
  misc_feature: GZ8MTXP02H7E7Z.21.70.G04.1.454.CMB.2.raw
  modified_base (408)..(408): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtccaccatatccgtagacacgtccaggaacctagttctccctgaagctgaactctctcgaccgccgacaggaccgtcgggtatattatttattgtgacgagactagtagttggtatttggcttacgtcgcccccttagttacggtatcgggacgttcggaggggccgaaaggggcccncgtacgtccgacccggttctcccgtctacgccctacccgaacccgaaacggggccccctaacgttcccgggttcccttccccccgcgggtccccgccccgtcggcccctacccgaacgggtaccgaccacccggtaccgaacgacgaccgaacgacggcccggtcccgtcgggcccgtcggcccgttgggtacgaaaccgggtacccttacccgttacccggacgaccggaaaccgaccgtacggaccgggccgggtaccgcgggaacggaccggg

SEQ ID NO: 361760 - DNA, 576 bp, Homo sapiens
  misc_feature: GZ8MTXP02GNMUT.21.70.G04.1.454.CMB.2.raw
  modified_base (462)..(462): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctcgaccgccgcacgacgcgggtatatattattgtgcgagacatagtgtattggctactcgcccctattacggtatggacgtcgtggggccaaagggccgcagtcaccgtctcctcagccctaccaccaacgggcccagtccggtcctccccctcggccgccctgcctccgacgggacncctacccgtccgaacgacgcgacacggccggcccgtgggcctcgccgtggtaccgaacggtacctaccgttcccgagccgaaccgactcggacgcggggctacgggacaacggg

SEQ ID NO: 361761 - DNA, 555 bp, Homo sapiens
  misc_feature: GZ8MTXP02JGXKQ.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagcccccagggaagggctggagtgggttgcgagtatttttcatgatgggaccactactataggtcgtcgctcaacagtcgagtcacatatccgtagacacgtccaggaaccagttcctccctgaagctagaactctctcgaccgccgcagacgcgggtatagtattagttgtcgtcgaagacataagtggtattggctactcgccttattacggtatggacgtcgtggggccgaagggaccgcgagttccacccgtcctccgtccacgccctccaccgacggccactccgtcctccccctggcccgtcccgtcgcctccgaacggacgccaacccgtccgacgacgcaaccgg

SEQ ID NO: 361762 - DNA, 796 bp, Homo sapiens
  misc_feature: GZ8MTXP02JLFP5.21.70.G04.1.454.CMB.2.raw
  modified_base (223)..(223): a, c, t, g, unknown or other
  modified_base (238)..(238): a, c, t, g, unknown or other
  modified_base (380)..(380): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtgggctggactccgccacgccccgagggaggctggngtgggtgcgtagttnttttcatgtagtcggacctacgtactagtacggtcgtcgtactacaacacggtcgacgtcaacctatacttaccgagacccacgttaccgaaggaacctcggtttcctaccccgtagaacgtctaacgtaaccttccgtacncccggacccgccgaccgaagggaccggtacgggttaatacgtttagtttacgttacgggtcgacggttaaacgaacgttaggttaacgggttaggtttaaggtttccggtaccgttaccgttacccgttaccctttaaacggttacgggttacggttacgggtaaccggttcgggttaccgggggaacccgtaaacgggggaccccgtaaccgtacggttcccgtaccccggtttccttcccgtacgaacccgttcccgtaaccccggaacccggtaaaccgggtcccccgtaaaccggtttcccccggttcccccgtttccccccgggtagggttcccccgtaccccgttcggcccgtaccggaacggacccgtttaaccgaccccgtaccggaacgtaccggaccgaacccggg

SEQ ID NO: 361763 - DNA, 735 bp, Homo sapiens
  misc_feature: GZ8MTXP02G1TPI.21.70.G04.1.454.CMB.2.raw
  modified_base (338)..(338): a, c, t, g, unknown or other
  modified_base (372)..(372): a, c, t, g, unknown or other
tcagtcgtcgctcgcacgaccggtgctcgatttagtgtagtgtgaagggaaagggtctccgaaggcttcaccagtcctgggcccgactcctgtcccagctgcagctgcaggagtcgggcccaggactggtgaagccttcggagaccctgtccctcacctgcactgtctctggtggctccatcatcaatggtctattatcacgtgggctggactccgccacgccccgagggaagggctggaggtgggtgacgtagttattttcagtgagtcgggacctacctactagtacggtcgtcgctacaacgacgtacgacgtccaacctattacgtaccgtaanaccgtacgtaccgaacggtaacctacgtttaccnccgtagaacgtctacgtaacctctacgtacgacccgccgacgacgaccggtacggttaaacttaattaacgtttagttgtcgacgaacgtaaactaagttaggttggttaaacgtttcgggacccttacgtcccgttaccccttaggttaacgggttaacgttcggggtaccgttacgggtacgggggaacccgtaacgggggacccgtacgtacggtacccgtacccgtccgttcccaccgtaccgcccctacccgaaccccgaaacggggtcccctaccggttccccggttccccttcccccggtcggtccccgccccgtcgtacccgtcccggaacggtaccgtacccacccgtaaccgg

SEQ ID NO: 361764 - DNA, 566 bp, Homo sapiens
  misc_feature: GZ8MTXP02FITZL.21.70.G04.1.454.CMB.2.raw
  modified_base (402)..(402): a, c, t, g, unknown or other
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaacccagtctccctgaagctgaactctctgaccgccgcagaccgcgggtatatattattgtgcgagacatgtggtattggctactcgccccctattacggatggacgtcgtggggccaaggggccgcagtcaaccggttctccctcncgccctcccaaccaagggccccaagtccgggtccttccccccgtcggccgccccgtacgcctccgacggagccaacccgtcccgagacgcacagccgcccgtgggctcgcctggtcaaaggactacgtcccgagcgaacgctcggacgcggctcgggcaacggg

SEQ ID NO: 361765 - DNA, 709 bp, Homo sapiens
  misc_feature: GZ8MTXP02G5LQ7.21.70.G04.1.454.CMB.2.raw
  modified_base (233)..(233): a, c, t, g, unknown or other
  modified_base (246)..(246): a, c, t, g, unknown or other
  modified_base (694)..(694): a, c, t, g, unknown or other
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtactattatcgacgtgggctggactccgccacgacccgagggagggctggagtggtnacgtagttatttnagtgagtcggacctacgtatagtagtcgtcgctacaagacgtcgacgtaccactattacgtccgaagacccacgtaccgaacggtacctacgttccacccgtaggaactcgtaacgtaacctcgtaccgtcccgacccgccgtacgaaacggtacggtaacggtttaattacttagtttcgtaggtacgacgtacgtaataagttaggtacgttagttcgtaccttacgtacccgttacgttagttacggttaggtaccggtacggttccggtaaacgggaacccgggtaaacgggccctacgtaacgggttccccgtaaccgtcccgtaccgtacgacccgtcccgtaacccgaaaccgggtaaccgcccgtttacggtcccggttcccttccccggcgtacccgtccgtaacgcccgaacgcggacctacccgacccgtaggaccncggaacgtttcccgg

SEQ ID NO: 361766 - DNA, 634 bp, Homo sapiens
  misc_feature: GZ8MTXP02JGSQO.21.70.G04.1.454.CMB.2.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgcccccgagggaaggggctggaggtgggttgcgtagttattttcatgagtggaccactactagtaggtcgcgactcgaacagtcgagtcacatatcccgagacacgtccaaggtaccagttcctaccctgaagtctagaacctctctccgacccgcgcacgacgcggttaatctattagtgtgacgagtacagtagtgtatgctaactcgacccttagtacgggtatggacgtacgcggggaccgaacgggaccgcgaacgtccgaacccgtctccctacgacgtcccgtacccaaaccggaaccgggtccctaacgttccccggtttccccgttacccccgttcgggaccccgtcccttaccgggcccttacccggaacggtacccgaacccgacccttacccggaacggaccggacccaaccggg

SEQ ID NO: 361767 - DNA, 535 bp, Homo sapiens
  misc_feature: GZ8MTXP01DDHJM.3.23.C01.1.454.CMB.2.raw
  modified_base (275)..(275): a, c, t, g, unknown or other
  modified_base (373)..(373): a, c, t, g, unknown or other
  modified_base (481)..(481): a, c, t, g, unknown or other
  modified_base (485)..(485): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttgggtgcaggccgggtgggtccctgcgactctcctgtgcaatttctgaacgccccttcaatacagtgtggatgaattgggtccgcaggctcgagggaagggctggagtggtgcatanaaaagtagactgctggtgagacaacagactacgctgctgccttcagaggcagattcacatccttcagagatgaaaatcaacagagcaactctgtttcngacaaatgaaacagcctaggaaagacggcggaacacagcaatgtattaattgtaacagttagaactactatacgtcccgtaggggccagggaaccctcgtcaccgtcnctcncgcccttcaaccgaacgggccctaatccggtcttccccgtggccgccccg

SEQ ID NO: 361768 - DNA, 556 bp, Homo sapiens
  misc_feature: GZ8MTXP01CLPZQ.3.23.C01.1.454.CMB.2.raw
  modified_base (241)..(241): a, c, t, g, unknown or other
  modified_base (275)..(275): a, c, t, g, unknown or other
  modified_base (496)..(496): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctggggggaggcttggtgcaggccgggtgggtccctgcgactctcctgtgcaatttctgaacgccccttcaatacagtgtggatgaattgggccncaggctcgagggagggctggagtgggtgcataanaaaagtagactgctggtgagacaacagactacgctgctgccttcagaggcagattcaccatcctcagagatgaaatcaacagagcactctgtttcagacaaatcgaacagaccgtaggaacgacgacggacactagaccatgttaattattgtaactagttagactactatacgtccgtggggaccaacggggtaccctcggtcacccgttcttcccgtcncgcccttccacccgaacgggcccctaagtcccggtcccttcccccgtcggcccgtccccg

SEQ ID NO: 361769 - DNA, 543 bp, Homo sapiens
  misc_feature: GZ8MTXP01CF7CI.3.23.C01.1.454.CMB.2.raw
  modified_base (248)..(248): a, c, t, g, unknown or other
  modified_base (281)..(281): a, c, t, g, unknown or other
  modified_base (306)..(306): a, c, t, g, unknown or other
  modified_base (379)..(379): a, c, t, g, unknown or other
  modified_base (490)..(490): a, c, t, g, unknown or other
tcagagacgcactccacgaccggtgctcgatttagtacacgtgatcaggactgaacacagaggactcaccatggattttgggctgaggtggattttccttgctgcctatttttaaaaggtttccactgtgagctgcgactgggtggcgtcgtggggggaggcttggtgcaggccgggtgggtccctgcgactctcctgtgctaatttctgaacgccccttacaatacagtgtggatgaattgggtccncaggctcgagggagggctggagtgggtgcatanaaaagtagactgctggtgagacaanagactacgctgctgccttcagaggcagacttcaccatccttcagagatgaaatcaacagagctactctgttcngacaaatgaacagcctaggaacgcgacgacacagcatagtattatagtactagttagactagtagtacgtcccgtggggaccacgggaaccctcgtcacccgtcttcctcncgcccttccaccgtaacggccctaacgtccgtccttccccgtggcccgtcccg

SEQ ID NO: 361770 - DNA, 659 bp, Homo sapiens
  misc_feature: GZ8MTXP01DFZI1.3.23.C01.1.454.CMB.2.raw
  modified_base (209)..(209): a, c, t, g, unknown or other
  modified_base (247)..(247): a, c, t, g, unknown or other
  modified_base (280)..(280): a, c, t, g, unknown or other
  modified_base (287)..(287): a, c, t, g, unknown or other
  modified_base (304)..(304): a, c, t, g, unknown or other
  modified_base (314)..(314): a, c, t, g, unknown or other
  modified_base (323)..(323): a, c, t, g, unknown or other
  modified_base (574)..(574): a, c, t, g, unknown or other
tcagagacgcactccacgaccggtgctcgatttagtacacgtgatcaggactgaacacagaggactcaccatggactttgggctgaggtggattttccttgctgcctaatttttaaaaggtttccactgtgagctgcgactggtggcgtcgtggggggaggcttggtgcaggccgggtgggtccctgcgactctcctgtgctaatttcngaacgccccttacaatacagtgtggatgaattgggccncaggctcgagggagggctggagtggtgcataanaaaaganactgctggtgagacaanagactacgcngctgccttnagaggcagtattcacatcctacagagatagaaatcaacagagctaactcttagtttcagactaaatagaacagccgtaggaaacgaccgacggaaacacgacgacctaattagttaatttagtttacggtaactaagttaaacggaacctaacgtaacgttaaccggtccccggtacgggggaaccccgtaaaccggggtaaaccccttccggtaacccgttacccggttaccttcccgtaccggtaaccnccccgttacccgaaaccccggtaaaccggggtcccctaacgttccccggggttccccttccccccggtcgggttccccgtccccg

SEQ ID NO: 361771 - DNA, 523 bp, Homo sapiens
  misc_feature: GZ8MTXP01AJQSU.3.23.C01.1.454.CMB.2.raw
  modified_base (274)..(274): a, c, t, g, unknown or other
  modified_base (355)..(355): a, c, t, g, unknown or other
  modified_base (370)..(370): a, c, t, g, unknown or other
  modified_base (469)..(469): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccgagggaggggctggagtggtgcatanaaaagtagactgctggtgagacaacagactacgctgctgccttcagagcagattcaccatccttcagagatgaaatcaacngacgcactctgttcngacaaatgaacagcctaggaagacgacggacacagccatgtaattatgtacattagactactagtacgtccgtgggaccacgggaccctcgcaccgtcncctcacgccttccaccgaacggcccaacgtcgtccttccccgcggttccgcccg

SEQ ID NO: 361772 - DNA, 602 bp, Homo sapiens
  misc_feature: GZ8MTXP01EYUU3.3.23.C01.1.454.CMB.2.raw
  modified_base (243)..(243): a, c, t, g, unknown or other
  modified_base (275)..(275): a, c, t, g, unknown or other
  modified_base (319)..(319): a, c, t, g, unknown or other
  modified_base (544)..(544): a, c, t, g, unknown or other
tcagagacgcactccacgaccggtgctcgatttagtacacgtgatcaggactgaacacagaggactcaccatggactttgggctgaggtggattttccttgctgccattttaaaaaggtttccactgtgagctgcgactggtggcgtcgtggggggaggcttggtgcaggccgggtgggtccctgcgactctcctgtgcaatttctgaacgccccttcaatacagtgtggatgaattgggccncaggctcgagggagggctggagtggtgcatanaaaagtagactgctggtgagacaacagactacgctgctgccttnagaggcagacttcacatccttcagagatgaaaatcaacagagcactcttgttctagactaaatgaaacacgaccgtagggaaacgacggacggaacacgacgacctaagttagttaatttaagttacgtaactaagttaaggaacctaacgttagttaaccggtcccggtgggggaccccgaacggggtaacccctcggtccttacccggtccttcccgccgacncccgttcccaccgaacgggccctaacgtcccggtcccttccccgtcggcccgtccccg

SEQ ID NO: 361773 - DNA, 527 bp, Homo sapiens
  misc_feature: GZ8MTXP01EQ1LD.3.23.C01.1.454.CMB.2.raw
  modified_base (239)..(239): a, c, t, g, unknown or other
  modified_base (271)..(271): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaacgccccttcaatacagtgtggatgaattgggccncaggctcgagggagggctggagtggtgcatanaaaagtagactgctggtgagacaacagactacgctgctgccttcagaggcagattcaccatccttcagagatgaaaatcaacagagcactctgtttctgcaaatgaaacagacctaggaaagacgcggacacagccaatgtaattattgtacattagacactatacgtccctggggaccagggaaccctcgtcaccgtcttcctcagcccttccaccgaagggcccaacgtccggtccttccccgtggcccgtccc

SEQ ID NO: 361774 - DNA, 598 bp, Homo sapiens
  misc_feature: GZ8MTXP01EOB7V.3.23.C01.1.454.CMB.2.raw
  modified_base (208)..(208): a, c, t, g, unknown or other
  modified_base (245)..(245): a, c, t, g, unknown or other
  modified_base (262)..(262): a, c, t, g, unknown or other
  modified_base (277)..(277): a, c, t, g, unknown or other
  modified_base (302)..(302): a, c, t, g, unknown or other
tcagagacgcactccacgaccggtgctcgatttagtacacgtgatcaggactgaacacagaggactcaccatggactttgggctgaggtggattttccttgctgcctaattttaaaaggtttccactgtgagctgcgactggtggcgtcgtggggggaggcttggtgcaggccgggtgggtccctgcgactctcctgtgctaatttcngaacgccccttcaatacagtgtggatgaattgggccncaggctcgagggagggntggagtggtgcatanaaaagtagctgctggtagagacaanagactacgctgctgccttcagaggcagacttcacctatcctacagagatagaaaatcaacgagacgctactcttgttcagacaaatgaacagacctaggaaacgacgacgacacgagccattagttatttaattagtaactaagttaggaactacttaagtaacggtcccgtaggggtaccgtaacgggaacccctcgtcccaccgtccttaccctacgaccgaccccttcccaaccccggaacgggtcccctaacgttccccggtcccgttcccccggttcggccccggtccccg

SEQ ID NO: 361775 - DNA, 570 bp, Homo sapiens
  misc_feature: GZ8MTXP01ANLI1.3.23.C01.1.454.CMB.2.raw
  modified_base (207)..(207): a, c, t, g, unknown or other
  modified_base (244)..(244): a, c, t, g, unknown or other
  modified_base (277)..(277): a, c, t, g, unknown or other
  modified_base (377)..(377): a, c, t, g, unknown or other
  modified_base (400)..(400): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactgggtggcgtcgtgggggaggcttggtgcaggccgggtgggtccctgcgactctcctgtgctaatttcngaacgccccttcaatacagtgtggatgaattgggccncaggctcgagggagggctggagtggtgcataanaaaagtagactgctggtgagacaacagactacgctgctgccttcaggacggcagattccaccattcccttacagagatgaaaactcaacagaagctactnttgttactagacaaatcgaaacngccgtaggaacgacgcggacacacgcattcgtaattacttagtactattaaggactacgtacgtacgtcccgtagggggacccaacggggaaccctcggtcaccgtcttccgtcacgcccttccgaccgaacgggccctaacgtccggtcccttccccgtgcccgtcccg

SEQ ID NO: 361776 - DNA, 645 bp, Homo sapiens
  misc_feature: GZ8MTXP01ASADQ.3.23.C01.1.454.CMB.2.raw
  modified_base (246)..(246): a, c, t, g, unknown or other
  modified_base (279)..(279): a, c, t, g, unknown or other
  modified_base (377)..(377): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctggggggaggcttgggtgcaggccgggtgggtcccctgcgactctcctgtgctaatttctgaacgccccttccaatacagtgtggatgaattgggtccnccaggctcgagggagggctggagtggtgcatanaaaagtagactgctggtgagacaacagactacgctgctgccttcagaggcagattcactatccttcagagatgaaatcaacagagctactcttgttcngacaaatgaacagaccgtagggaaacgacggacggaaccacacgacctaattggttaatttattaggttaactaagttacggtaacctaacgttaacgttaaccggtcccgttacggggggacccgtaaccggggtaaccccgttccggtacccgttacccgttcccttacccgtacctacgcccccgttcccgaaaccccggtaaccggggaccccctaacggttccccggttccccgtttccccccggtcgggccccgtcccccgg

SEQ ID NO: 361777 - DNA, 617 bp, Homo sapiens
  misc_feature: GZ8MTXP01EYIY7.3.23.C01.1.454.CMB.2.raw
  modified_base (249)..(249): a, c, t, g, unknown or other
  modified_base (282)..(282): a, c, t, g, unknown or other
  modified_base (300)..(300): a, c, t, g, unknown or other
  modified_base (326)..(326): a, c, t, g, unknown or other
  modified_base (346)..(346): a, c, t, g, unknown or other
tcagagacgcactccacgaccggtgctcgatttagtacacgtgatcaggactgaacacagaggactcaccatggactttgggctgaggtggattttccttgctgcctaatttttaaaaggtttccactgtgagctgcgactgggtggcgtcgtggggggaggcttgggtgcaggccgggtgggtccctgcgactctcctgtgctaatttctgaacgccccttacaatacagtgtggatgaattgggccncaggctcgagggagggctggagtggtgcaatanaaaagtagactgctggtnagacaacagactacgctgctgccttnagaggcagattcacatcctnagagatagaaatcaacagagcacttcttgttcagacaaatgaaacacgaccgtagggaaacgacgacggaacacgaagccaagttagttaattacgttagtaactagttaacggactacttagtacggtcccgtggggaccgaacggggaaccctcggtcccgttaacccgtccttacccgtccgaacggccccttcccgaaaccccggtaaacggggccccctaacggttccccggttccccgttaccccccgtcgggccccgtcccccg

SEQ ID NO: 361778 - DNA, 687 bp, Homo sapiens
  misc_feature: GZ8MTXP01CIBL0.3.23.C01.1.454.CMB.2.raw
  modified_base (245)..(245): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtcgtggggggaggcttggtgcaggccgggtgggtccctgcgactctcctgtgcaatttctgaacgtccccttcaatacagtgtggatgaattgggtccncaggctcgaggggagggctggagtgggtgtcataagaaaagtagactgctgggtagagacaacagactacgctgctgccttagagaggcagattccactattccttacgagaagtatagaaaactcgaacaggacgcctacttcgttgtttcagtactaaagtacgaacgacggacgtagggaaacgaccggacggaccacgacgacctagttagttaatttagtttacgtaacgtaagtttacgggaactacgttaagttaccgggtcccgtacgggggtacccgtaaccggggtaacccctcggttacccgacccggttccttacccgttaaccgccggttacccccttacccgaaccccggtaaacccgggggtccccctaacggtttcccccgggtttaccccgtttccccccgggtccgggttccccgttcccccgg

SEQ ID NO: 361779 - DNA, 551 bp, Homo sapiens
  misc_feature: GZ8MTXP01EM8I9.3.23.C01.1.454.CMB.2.raw
  modified_base (243)..(243): a, c, t, g, unknown or other
  modified_base (277)..(277): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtctggggggaggcttggtgcaggccgggtgggtccctgcgactctcctgtgcaatttctgaacgccccttcaatacagtgtggatgaattgggtccnccaggctcgagggagggctggagtgggtgcatanaaaagtagactgctggtgagacaacagactacgctgctgccttcagaggcagattcaccatccttcagagatgaaatcaacagagcctactacttgtttctagacaaatgaaacagcctaggaacgacgacggacacagccagtgttattattgtaactagttaggacactatacgtcccgtggggaccacgggaaccctcgtccaccgtcttcctcgacgcccttccaccgaacgggccctaacgtccggtccttccccgtcggccgtccccg

SEQ ID NO: 361780 - DNA, 620 bp, Homo sapiens
  misc_feature: GZ8MTXP01DWCTG.3.23.C01.1.454.CMB.2.raw
  modified_base (248)..(248): a, c, t, g, unknown or other
  modified_base (282)..(282): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactggtggcgtcgtggggggaggcttgggtgcgaggccggggtgggtccctgcgactctcctgtgctaatttctgaacgtccccttcaatacagtgtggatgaattgggccncaggctcgaggggagggctggagtggtgcataanaaaagtagactgctggtgaagacaacagactacgctgctgtccttagaggaggcaagtacttaccactattccttacagagatagaaaactcgaacgagacgactacttcgttgtttactagtaaccaaagtacgaacagaccgtaagggaaacgacgacggacacgacgactattagttatttatagtactaagtacgactactacgtacgtccggtacggggaccgacgggtacccctcgtccttacccgtccttccgtacgccgttacccgttcccgaacccgtaaccgggtccctaacgtccccggttccccttaccccgtcggccccgtcccg

SEQ ID NO: 361781 - DNA, 648 bp, Homo sapiens
  misc_feature: GZ8MTXP01D6TAO.3.23.C01.1.454.CMB.2.raw
  modified_base (244)..(244): a, c, t, g, unknown or other
  modified_base (276)..(276): a, c, t, g, unknown or other
  modified_base (284)..(284): a, c, t, g, unknown or other
  modified_base (289)..(289): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactggtggcgtcgtggggggaggcttggtgcaggccgggtgggtccctgcgactctcctgtgcaatttctgaacgccccttcaatacagtgtggatgaattgggtccncaggctcgagggagggctggagtggtgcatanaaaagtanactgntggtgagacaacagactacgctgctgccttcagagcagattcacatcctcagagatagaaatcaacgagacgactactcttgtttctagacaaatgaacacgccgtagggaaacgacggacggaacacgacgaccaattagttaatttatttagtaactaagttaacggactaacgttaacgttacgtcccggttacggggacccgtaaccggggtaacccctcggttacccgacccggttcccttaccccgtaacccgtacggttcccccgttaacccgaaaccccggaaaccgggggtcccctaaccggtttccccggttccccgtttccccccgtcgggggttccccgtccccccg

SEQ ID NO: 361782 - DNA, 720 bp, Homo sapiens
  misc_feature: GZ8MTXP01EMDUK.3.23.C01.1.454.CMB.2.raw
  modified_base (210)..(210): a, c, t, g, unknown or other
  modified_base (248)..(248): a, c, t, g, unknown or other
  modified_base (265)..(265): a, c, t, g, unknown or other
  modified_base (300)..(300): a, c, t, g, unknown or other
  modified_base (331)..(331): a, c, t, g, unknown or other
  modified_base (384)..(384): a, c, t, g, unknown or other
  modified_base (424)..(424): a, c, t, g, unknown or other
tcagagacgcactccacgaccggtgctcgatttagtacacgtgatcaggactgaacacagaggactcaccatggactttgggctgaggtggattttccttgctgcctaatttttaaaaggtttccactgtgagctgcgactggtggcgtcgtggggggaggcttgggtgcaggccgggtgggtccctgcgactctcctgtgctaatttcngaacgccccttacaatacagtgtggatgaattgggccncaggctcgagggagggntggagtggtgcataagaaaagtagctgctaggtanaagaacaacagaactacgctgctgtccttanaggagcagtacttcaccgtatccttacgagagatagaaaactcaacgaggacncctacttcgttcggtttacagaactaaaagtacgaaaccnggacccgtaggggaaacgaccggacggaacaacgtacgacctaagttagttaagtttaagtttacggtaaactaagttaaacggtaaccaacgttacgttaaccgggtccccggtgggggaccccaaccggggttaaacccctccggttacccttacccggttaccttccccgtaccgtaacccgccccttaccccggaaaaccccggtaaacccgggggtacccccttaaccgggtttccccgggttacccccggttttaccccccgtcccgggggttccccttaaccccccggg

SEQ ID NO: 361783 - DNA, 650 bp, Homo sapiens
  misc_feature: GZ8MTXP01BM4SU.3.23.C01.1.454.CMB.2.raw
  modified_base (209)..(209): a, c, t, g, unknown or other
  modified_base (269)..(269): a, c, t, g, unknown or other
tcagagacgcactccacgaccggtgctcgatttagtacacgtgatcaggactgaacacagaggactcaccatggactttgggctgaggtggattttccttgctgcctaatttttaaaaggtttccactgtgagctgcgactggtggcgtcgtggggggaggcttggtgcaggccgggtgggtccctgcgactctcctgtgctaatttcngaacgtccccttacaatacagtgtggatgaagttcgggccgcaggctccgaggggagggntggagtgggttgcataataaaagagactgctggtgagacaacagactacgctgctgcctttcaggaggcagattcaacctatccttacagagatagaaatcaagagacgctacttcgttacggtttctaggtactaaaagtcgaaacgacggtacccgtagggaaaacggaccggacgggaaccaaccgacgacctaattaggttaatttagtttacgtaactagtttaaggactaacgttattaccggtccgtacgggaccgtaccgggaaccctccggtacacccgttccttcccgttaccaccgttcccgttccgaaccccgtaaccgggcccctaaccgttcccggtccccgttcccccgtcggttccccgtccccg

SEQ ID NO: 361784 - DNA, 570 bp, Homo sapiens
  misc_feature: GZ8MTXP01EME1I.3.23.C01.1.454.CMB.2.raw
  modified_base (242)..(242): a, c, t, g, unknown or other
  modified_base (259)..(259): a, c, t, g, unknown or other
  modified_base (275)..(275): a, c, t, g, unknown or other
  modified_base (293)..(293): a, c, t, g, unknown or other
  modified_base (342)..(342): a, c, t, g, unknown or other
  modified_base (364)..(364): a, c, t, g, unknown or other
tcagagacgcactccacgaccggtgctcgatttagtacacgtgatcaggactgaacacagaggactgaccatggactttgggctgaggtggattttccttgctgcctattttaaaaggtttccactgtgagctgcgactggtggcgtcgtgggggagcttggtgcaggccgggtgggtccctgcgactctcctgtgctaatttctgaacgccccttcaatacagtgtggatgaattgggccncaggctcgaggggaggntggagtggtgcataanaaaagagactgctggtanagacaacagactacgctgctgccttcagaggcagacttcaccatccttnagagatgaaaactcaacagacnctacttctagtttcagactaaatgaacacgccgtagggaaacgacgacggacacgtacgctaagtgttagttattgtaactagttaagactacgtataacgtcccgtaggggacctacggaaccctcgtcttaccgtcttaccgtcaccgccttccaccggaaccggccctaacgttcccggtcccttccccgcggcccgtccccg

SEQ ID NO: 361785 - DNA, 626 bp, Homo sapiens
  misc_feature: GZ8MTXP01EUO8R.3.23.C01.1.454.CMB.2.raw
  modified_base (209)..(209): a, c, t, g, unknown or other
  modified_base (214)..(214): a, c, t, g, unknown or other
  modified_base (245)..(245): a, c, t, g, unknown or other
  modified_base (280)..(280): a, c, t, g, unknown or other
  modified_base (327)..(327): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactgggtggcgtcgtggggggaggcttgggtgcaggccgggtgggtccctgcgactctcctgtgctaatttcngaacnccccttcaatacagtgtgatgaattgggccncaggctcgagggagggctggagtgggtgcaataanaaaagtagactgcgtggtgagacaacgagactacgctgctgccttanagaggcagtactcacctatcctacagagatagaaaatcaactagacgctacttcttgttctagactaaatgaacacgaccgtagggaaacgacggtacggaacacgacgacctaattagttaatttatttagtaactagttaacggaacctacgttaacgttaccggtccggtacggggtaccgtaaccgggtaacccctcggtacccttacccgtccttacctccgacgttccccttaccgacccgaaccgggtccctccggtacccggtccccttaccccgtcggttccccgtcccg

SEQ ID NO: 361786 - DNA, 533 bp, Homo sapiens
  misc_feature: GZ8MTXP02JVRY0.3.23.C01.1.454.CMB.2.raw
  modified_base (202)..(202): a, c, t, g, unknown or other
  modified_base (239)..(239): a, c, t, g, unknown or other
  modified_base (369)..(369): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttcngaagccccttcaatacagtgtggatgaattgggtccncaggctccagggagggctggagtgggtgccatataaaagtagactgctggtgagacaacagactacgctgctgccttcagaggcagattcaccatccttacagagatgaatcacagagcactctgtttcngacaaatgaacagcctaggaagcgcggacacagccaatgtattatgtacattaagactactatacgtcccgtgggaccacgggaaccctcgtacaccgtctccgtacacgccctaccaaccgaacgggccccagtcccggtccttcccccgtggcccgtccccg

SEQ ID NO: 361787 - DNA, 622 bp, Homo sapiens
  misc_feature: GZ8MTXP02GFA97.3.23.C01.1.454.CMB.2.raw
  modified_base (241)..(241): a, c, t, g, unknown or other
  modified_base (319)..(319): a, c, t, g, unknown or other
  modified_base (371)..(371): a, c, t, g, unknown or other
  modified_base (604)..(604): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaacgccccttccaatacagtgtggatgaattgggtccncaggctccagggagggctggagtgggtgcatataaaaagtagactgctggtgagacaacagactacgctgctgccttnagaggcagattcaccatccttacagagatgaatcacagagcactctgtttcngacaaatgaacagcctgggaaacgacggcggaacacacgtccaattcgtaatttagttgtaactaagtttacggaaactacgttaactacggtaccccgttgggggacccaacgggggtaaacccccttcgggtaccaacccggtttcctaccccttacacccggtacccttaccccgaaacccggaaacggggtccccctaacggtttcccggggtcccctttccccccggnggggtacccctcccccgg

SEQ ID NO: 361788 - DNA, 546 bp, Homo sapiens
  misc_feature: GZ8MTXP02G6HCF.3.23.C01.1.454.CMB.2.raw
  modified_base (272)..(272): a, c, t, g, unknown or other
  modified_base (289)..(289): a, c, t, g, unknown or other
  modified_base (316)..(316): a, c, t, g, unknown or other
  modified_base (340)..(340): a, c, t, g, unknown or other
  modified_base (365)..(365): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgcatgctccaggggagggctggagtggtgcatanaaaagtagactgctggngagacaacagactacgctgctgccttnagaggcagattcaccatctcaganatgaatcacagagcactctgtttcngacaaatgaaacagccctaggaaacgacgacggaacacgagaccattgtaatttatgtaacattaaggactactatacgtcccgtaggggacccaacgggtaacccctcggtccaccgtcctaccctcgacgccctaccaaccgaacggccccacgtccggtcccttcccccgtggccccg

SEQ ID NO: 361789 - DNA, 549 bp, Homo sapiens
  misc_feature: GZ8MTXP02IIE1F.3.23.C01.1.454.CMB.2.raw
  modified_base (240)..(240): a, c, t, g, unknown or other
  modified_base (304)..(304): a, c, t, g, unknown or other
  modified_base (326)..(326): a, c, t, g, unknown or other
  modified_base (388)..(388): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccnccaggctccgagggaaggggctggagtggtggccatataaaaagtagactgctggtgagacaanagactacgctgctgccttcagnggcagattcaccatccctcagagatgaaatcacagagcactctgtttctgacaaatgaaacngacctaggaaacgacgacggaacacgagccatgtaattattgtaactagttagacactatacgtcccgtaggggccaacgggaaccctcgaccaccgtctcctcacgccctaccaaccgaacggcccaacgttcccggtccttcccccgtggccctccccg

SEQ ID NO: 361790 - DNA, 518 bp, Homo sapiens
  misc_feature: GZ8MTXP02IL9AP.3.23.C01.1.454.CMB.2.raw
  modified_base (239)..(239): a, c, t, g, unknown or other
  modified_base (319)..(319): a, c, t, g, unknown or other
  modified_base (367)..(367): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccncaggctccagggagggctggagtggtggcatataaaagtagactgctggtgagacaacagactacgctgctgccttcagnggcagattcaccatccttcagagatgaatcacagagcactctgtttcngacaaatgaacagcctaggaagcgcggacacagccatgtattattgtacattagacactatacgtcccgtgggccacgggaaccctcggtcaccgtctcctcacgcctccaccaacgggcccagtccggtccttcccccgtggccctcccg

SEQ ID NO: 361791 - DNA, 548 bp, Homo sapiens
  misc_feature: GZ8MTXP02F2BG7.3.23.C01.1.454.CMB.2.raw
  modified_base (239)..(239): a, c, t, g, unknown or other
  modified_base (371)..(371): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggagcttggtgcaggccgggtgggtccctgcgactctcctgtgcaatttctgaacgccccttcaatacagtgtggatgaattgggccncaggctccgagggagggctggagtgggtgcatataaaaagtagactgctggtgagacaacagactacgctgctgccttcagaggcagattcaccatcccttcagagatgaaatcacagagcactctgtttcngacaaatgaacagcctaggaaacgcggacggaacacgacgccattagtattattgtacattaggactatatacgtccgtggggacctacgggaaccctcgtaccaccgttcctcctcaccgtccctccgaaccgaacgggcccaacgtcccggtcccttccccgtcggcccgtcccg

SEQ ID NO: 361792 - DNA, 595 bp, Homo sapiens
  misc_feature: GZ8MTXP02IRUDW.3.23.C01.1.454.CMB.2.raw
  modified_base (241)..(241): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgctaatttctgaacgccccttcaatacagtgtggatgaattgggtccncaggctcgagggaagggctggagtgggtggccatataaaagtagactgctggtgagacaacagactacgctgctgccttcagaggcagattcacatccttcagagatagaactcacagacgcacttcttgtttctgacaaatgaacagcctaggaagacgcggaacacgagcctagtagttattattagtactagttaaggactacttaatacgtcccgtggggtacccaaggggtaacccccttcggacctacccggttcctacccgtccgtaccgtaccccttacccgaacccgaaaccgggcccctaacgttcccgggtaccctttccccccgtcgggtccccgtcccccg

SEQ ID NO: 361793 - DNA, 619 bp, Homo sapiens
  misc_feature: GZ8MTXP02HU6X2.3.23.C01.1.454.CMB.2.raw
  modified_base (210)..(210): a, c, t, g, unknown or other
  modified_base (303)..(303): a, c, t, g, unknown or other
  modified_base (311)..(311): a, c, t, g, unknown or other
  modified_base (331)..(331): a, c, t, g, unknown or other
  modified_base (370)..(370): a, c, t, g, unknown or other
  modified_base (608)..(608): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtcgtgggggaggcttggtgcaggccgggtgggtccctgcgactctcctgtgcaatttctgaacnccccttcaatacagtgtggatgaattgggtccgccaggctccgaggggaaggggctggagtgggttggccataataaaaagtagactgctggngagacaanagactacgctgcctgccttnagaggcagattcaccatcctcagagatgaaatcacaganctacttctgtttctgactaaaatcgaacagccgtagggaaacgaccggacggaaccacgacgtacccaaagtttagttaatttaacgtttagtaactaagtttaacggactaaacgttagttaaccggtccccggttagggggacccaacgggggtaaccccctggtaccgtacccgtctccctacacgtcccctacccgacgaaccgggcccctacgtcccggtccctttcccccgnggtccctcccg

SEQ ID NO: 361794 - DNA, 530 bp, Homo sapiens
  misc_feature: GZ8MTXP02IGORK.3.23.C01.1.454.CMB.2.raw
  modified_base (203)..(203): a, c, t, g, unknown or other
  modified_base (241)..(241): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaattttcngaacgccccttcaatacagtgtggatgaattgggtccncaggctccgagggagggctggagtgggtgcatataaaagtagactgctggtgagacaacagactacgctgctgccttcagaggcagattcacatcctcagagatgaaatcacagagcacttcttgtttcagactaaatgaaacagccgtaggaagacgcgacacagccatgtattatagtacagttagacatatcgtacccgtgggaccaacgggaccctcggtacaccgtcttccgctacgcctaccaccgtaacggccctagtccggtccttcccccgtgccgtccc

SEQ ID NO: 361795 - DNA, 523 bp, Homo sapiens
  misc_feature: GZ8MTXP02ICN0S.3.23.C01.1.454.CMB.2.raw
  modified_base (238)..(238): a, c, t, g, unknown or other
  modified_base (303)..(303): a, c, t, g, unknown or other
  modified_base (475)..(475): a, c, t, g, unknown or other
  modified_base (513)..(513): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcatttctgaagccccttcaatacagtgtggatgaattgggtccnccaggctccgagggaggggctggagtgggttggccatataaaaagtagactgctggtgagacaangactagctgctgccttcagagcagattcacatctcagagatgaatcacagagcactctgtttctgacaaatgaacagaccctaggaagacgcggacacagccatgtatattgactattagacactatacgtccgttggggccacgggaaccctcgtccaccgtctcctcacnccctccaccgaacggcccagtccggtcctttcccccgnggccctcccg

SEQ ID NO: 361796 - DNA, 600 bp, Homo sapiens
  misc_feature: GZ8MTXP02F26UQ.3.23.C01.1.454.CMB.2.raw
  modified_base (239)..(239): a, c, t, g, unknown or other
  modified_base (296)..(296): a, c, t, g, unknown or other
  modified_base (354)..(354): a, c, t, g, unknown or other
  modified_base (394)..(394): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccnccaggctcagggagggctggagtggtgcatataaaagtagactgctggtgagacaanagactacgctgctgccttcagaggcagattcaccatcctacagagatgaatcacagancactcttagtttctgacaaatgaaacagcctagggaaacncggacggaacacgagacccaagttgtaatttagtttgtaactaagttaacggaacctaacttacgtaacgtcccgtagggggacccaacggggtaaccccttcggtaccacccgttcctcccgtaccacggaccccctacccgaaaccggaaccgggtacccctacggttccccggttaccccttcccccggtcgggccctccccg

SEQ ID NO: 361797 - DNA, 527 bp, Homo sapiens
  misc_feature: GZ8MTXP02GOCQF.3.23.C01.1.454.CMB.2.raw
  modified_base (239)..(239): a, c, t, g, unknown or other
  modified_base (336)..(336): a, c, t, g, unknown or other
  modified_base (363)..(363): a, c, t, g, unknown or other
  modified_base (370)..(370): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaacgccccttcaatacagtgtggatgaattgggccncaggctccgagggagggctggagtgggtgccatataaaaagtagactgctggtgagacaacagactacgctgctgccttcagaggcagattcacctntcctcagagatgaatcacagagcactntgtttcngacaaatgaacagcctaggaagacgcggacacagccatgtattattgacagttagactactatacgtccgtggggccaacgggaaccctcgtccaccgtctccgtcacgccctaccaccgaacggcccagtcccgtcctcccccgtcggccgtcccg

SEQ ID NO: 361798 - DNA, 549 bp, Homo sapiens
  misc_feature: GZ8MTXP02HY107.3.23.C01.1.454.CMB.2.raw
  modified_base (327)..(327): a, c, t, g, unknown or other
  modified_base (387)..(387): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcaggccgggtgggtccctgcgactctcctgtgcaatttctgaagccccttcaatacagtgtggatgaattgggtccgccaggctccgagggaaggggctggagtgggttggccatataaaagtagactgctggtgagacaacagactacgctgctgccttcagnggcagattcacatcctcagagatgaatcacagagcacttctgtttctgacaaatgaaacngacctaggaagcgacggacacagccattgtaatttactttgtaactagttacggaacacgtagttacgtcccgttgggggaccaacggggaaccctcggtacctaccgtctcctcacgcctccacgaacggccctagtccggtcctccccgtcggcctcccg

SEQ ID NO: 361799 - DNA, 625 bp, Homo sapiens
  misc_feature: GZ8MTXP02G1WUR.3.23.C01.1.454.CMB.2.raw
  modified_base (312)..(312): a, c, t, g, unknown or other
  modified_base (322)..(322): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtcgtgggggaggcttggtgcagccgggtgggtccctgcgactctcctgtgcaatttctgaacgcccccttccaatacagtgtggatgaattgggccgccaggctccgagggaggggctggagtggtgccatataaaagtagactgctggtgagacaacagactacgntgctgccttnagagcagatcacctatcctcagagatgaatcacagagcactctgtttcagacaaatgaaacagcctaggaaagacggcgaacagacgcctaatgttaattagttagtaactaagtttacggaactaactaacgttaacggtcccccgttagggggacccctaacgggggaaacccccttcgggtaccctaaccccggttccctaccctccgaccgtaccccctaccccgaaacccgaaaccggggtccccctaacggttccccggtacccccgtttccccccggtacggcccccgtacccccg

SEQ ID NO: 361800 - DNA, 537 bp, Homo sapiens
  misc_feature: GZ8MTXP02H2B01.3.23.C01.1.454.CMB.2.raw
  modified_base (240)..(240): a, c, t, g, unknown or other
  modified_base (293)..(293): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaacgccccttcaatacagtgtggatgaattgggtccncaggctcgagggaggggctggagtgggtggcatataaaagtagactgctggtnagacaacagactacgctgctgccttcagagcagattcacatccttcagagatgaaatcacagacgctactcttgtttctgactaaatgaaacagcctaggaacgacgcggacacagcatgtattatagtactattagactatatcgtccgtcgggaccgacggggaacccctcgtaccacccgttcctcctacacgccctaccaaccgaacggcccagtcccgtcctcccccgtggcccgcccg

SEQ ID NO: 361801 - DNA, 556 bp, Homo sapiens
  misc_feature: GZ8MTXP02JPDYZ.3.23.C01.1.454.CMB.2.raw
  modified_base (364)..(364): a, c, t, g, unknown or other
  modified_base (372)..(372): a, c, t, g, unknown or other
  modified_base (385)..(385): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccgagggagggctggagtggtgcatataaaaagtagactgctggtgagaacaacagactacgctgctgccttcgagaggcagattcaccatcctcagagatgaatcacagagcactnttgtttcngacaaatgaacgngcctagggaaacgacgacggaacacacgaccaattgtaatttagttagtaactattaacgactaactagtacgtcccgtgggggaccacggggaaccctcggtaccaccgtcctcctcaccgtccctccaccgaacggcccacgtcccggtccctcccccgtggccctccg

SEQ ID NO: 361802 - DNA, 529 bp, Homo sapiens
  misc_feature: GZ8MTXP02JB8T1.3.23.C01.1.454.CMB.2.raw
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccgagggaaggggctggagtgggttgccatataaaagtagactgctggtgagacaacagactacgctgctgccttcagaggcagattcaccatccttcagagatgaatcacagagcactctgtttctgacaaatgaacacgcctaggaaacgacgacggacacgagccatgtaattatagtacattagacatatacgtccgtgggccagggaaccctcggcaccgtctcctcacgccctccaccgaacggcccacgttccggtcctcccccgtggccctcccg

SEQ ID NO: 361803 - DNA, 639 bp, Homo sapiens
  misc_feature: GZ8MTXP02HIJCZ.3.23.C01.1.454.CMB.2.raw
  modified_base (238)..(238): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggccnccaggctcgagggagggctggagtggtggcatataaaagtagactgctggtgagacaacagactacgctgctgccttcagaggcagattcaccatcctcagagatgaaatcacagacgcacttcttgtttctagacaaaattgaaacacggaccgttagggaaaacggaccggacgggaaacaaccgacgacccgtaattaggttaatttaagtttaggtaacctaagtttaacggaaactactaacttaacggttcccccgttagggggacccaacgggggtaacccccttcgtaccgtacccgttcctcccttccgaccgtccccgtacccaacccgaaaccggggtcccccaacgttccccgggttacccttccccccggttcgggacccgtcccccg

SEQ ID NO: 361804 - DNA, 556 bp, Homo sapiens
  misc_feature: GZ8MTXP02H71FD.3.23.C01.1.454.CMB.2.raw
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggccgccaggctccgagggagggctggagtgggttggccatataaaaagtagactgctggtgagacaacagactacgctgctgccttcagagcagattcacatccttcagagatgaatcacagagcactcttgtttctgacaaatgaaacagcctaggaaagaccggacggaacacacgccatgttaattaagttgtaactattaggaactactatacgtcccgtggggaccacgggaaccccttcgacctaccggtctcctccacgccctaccacccgaacgggccccaacgtcccggtccttcccccgtcgcccgtccccg

SEQ ID NO: 361805 - DNA, 541 bp, Homo sapiens
  misc_feature: GZ8MTXP02GZJ6N.3.23.C01.1.454.CMB.2.raw
  modified_base (241)..(241): a, c, t, g, unknown or other
  modified_base (275)..(275): a, c, t, g, unknown or other
  modified_base (300)..(300): a, c, t, g, unknown or other
  modified_base (319)..(319): a, c, t, g, unknown or other
  modified_base (336)..(336): a, c, t, g, unknown or other
  modified_base (347)..(347): a, c, t, g, unknown or other
  modified_base (373)..(373): a, c, t, g, unknown or other
  modified_base (490)..(490): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtctgggggaggcttggtgcagccgggtgggtccctgcgactctcctgtgcaatttctgaacgccccttcaatacagtgtggatgaattgggtccncaggctccgagggagggctggagtggtgcataanaaaagtagactgctggtgagacaanagactacgctgctgccttnagaggcagtactcaccntcccgtcaganatgaaatcacagagcactctgtttcngaacaaatagaaacagcctagggaaacgcggacgaacacgacgaccatagtatttactgtaacagttagactactatacgtcccgtggggaccacgggtaccctcgtccaccgttcncctcacgcctaccacgaacggcccacgtcggtccctccccgtgcccgtccc

SEQ ID NO: 361806 - DNA, 563 bp, Homo sapiens
  misc_feature: GZ8MTXP02I7O4U.3.23.C01.1.454.CMB.2.raw
  modified_base (239)..(239): a, c, t, g, unknown or other
  modified_base (301)..(301): a, c, t, g, unknown or other
  modified_base (370)..(370): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccncaggctcgagggaagggctggagtgggtggccatataaaaagtagactgctggtgagacaanagactacgctgctgccttcagaggcagattcacatccttcagagatgaatcacagagcactctgtttcngacaaatagaaacagccgtaggaaacacggacgacacagcctaatgtaattactgtaactagttaagacaactagtacgtcccgtggggacctacggggaaccctcggtaccacccggtctccctacaccgaccctaccaacccgaacgggccccaacgttcccggtcctttcccccggtcggcccgtccccg

SEQ ID NO: 361807 - DNA, 616 bp, Homo sapiens
  misc_feature: GZ8MTXP02H6ED1.3.23.C01.1.454.CMB.2.raw
  modified_base (243)..(243): a, c, t, g, unknown or other
  modified_base (302)..(302): a, c, t, g, unknown or other
  modified_base (345)..(345): a, c, t, g, unknown or other
  modified_base (350)..(350): a, c, t, g, unknown or other
  modified_base (361)..(361): a, c, t, g, unknown or other
  modified_base (365)..(365): a, c, t, g, unknown or other
  modified_base (611)..(611): a, c, t, g, unknown or other
tcagagacgcactccacgaccggtgctcgatttagtacacgtgatcaggactgaacacagaggactcaccatggactttgggctgaggtggattttcccttgctgccattttaaaggtttccactgtgagctgcgactggtggcgtcgtgggggaggctttggtgcagccgggtgggtccctgcgactctcctgtgcaatttctgaacgcccccttcaatacagtgtggatgaattgggtccncaggctcgagggaggggctggagtgggtgcataataaaagagactgctggtgagacaanagactacgctgctgccttcgagaggcagacttcaccatccctnaaganatagaatccanaganctactgtgttctagacctaaaatgaaacagccgaggaaacgacggacggaacacgacgacattgtaatttagttagactattaggactaacagttaccgtccggtacggggaccgtacggggaaaccccttcgtacccgtacccggtcctacccgtcgaccggacccccttaccggaaaccctaaccgggggacccccttaacgggttcccgggttaccccttttccccccgacggggttcccccnccccg

SEQ ID NO: 361808 - DNA, 562 bp, Homo sapiens
  misc_feature: GZ8MTXP02IWW24.3.23.C01.1.454.CMB.2.raw
  modified_base (202)..(202): a, c, t, g, unknown or other
  modified_base (239)..(239): a, c, t, g, unknown or other
  modified_base (279)..(279): a, c, t, g, unknown or other
  modified_base (296)..(296): a, c, t, g, unknown or other
  modified_base (318)..(318): a, c, t, g, unknown or other
  modified_base (336)..(336): a, c, t, g, unknown or other
  modified_base (549)..(549): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttcngaacgccccttcaatacagtgtggatgaattgggccncaggctcgagggagggctggagtggtgcatataaaagtanactgctggtgagacaanagactacgctgctgccttcagngcagatcacatctcaganatgaatcacagagcctactctgtttcagactaaatgaaacagacctaggaagacgacgacacagccatagtaattatttagtaactagttaaggaactacttaatacggtcccgtggggacccaacggggtaacccctcggtacctacccggtcctcctacgaccgaccctcccaaccgaacgggccccaacgttcccggtcccttcccccgnggtcccgtccccg

SEQ ID NO: 361809 - DNA, 526 bp, Homo sapiens
  misc_feature: GZ8MTXP02FTFDE.3.23.C01.1.454.CMB.2.raw
  modified_base (373)..(373): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccgagggaaggggctggagtgggttggcatataaaagtagactgctggtgagacaacagactacgctgctgccttcagaggcagattcaccatccttcagagatgaatcacagagcactctgtttcngacaaatgaaacagccgtaggaaacgacgacggaacacagccattgtattatgtacattagacatatacgtccgtgggccagggaccctcgtcaccgtctcctcacgccctccaccgaacggcccagtccggtccttccccgtcggcctcccg

SEQ ID NO: 361810 - DNA, 540 bp, Homo sapiens
  misc_feature: GZ8MTXP02IU3CE.3.23.C01.1.454.CMB.2.raw
  modified_base (305)..(305): a, c, t, g, unknown or other
  modified_base (374)..(374): a, c, t, g, unknown or other
  modified_base (398)..(398): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcaggccgggtgggtccctgcgactctcctgtgcaatttctgaacgccccttcaatacagtgtggatgaattgggtccgccaggctccgagggagggctggagtgggttggccatataaaaagtagactgctggtgagacaanagactacgctgctgccttcagaggcagattcacatccttcagagatgaatcacagagcactctgtttcngacaaatgaacagcctagggaaancgacggacacacgcatgttattattgacattaggactactatacgtcccgtggggaccacgggaaccctcggtaccaccgttctcctcacgtccctaccaccgtaacggcccagttccggtccttcccccgtggccctcccg

SEQ ID NO: 361811 - DNA, 667 bp, Homo sapiens
  misc_feature: GZ8MTXP02G2KUM.3.23.C01.1.454.CMB.2.raw
  modified_base (206)..(206): a, c, t, g, unknown or other
  modified_base (243)..(243): a, c, t, g, unknown or other
  modified_base (322)..(322): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtcgtgggggaggcttggtgcaggccgggtgggtccctgcgactctcctgtgctaatttcngaacgccccttcaatacagtgtggatgaattgggccncaggctcgagggagggctggagtgggtgccatataaaaagtagactgctggtgagacaacagactacgctgctgccttnagaggcagattcacatcctcagagatgaatcacagagcactctagtttcagactaaatcgaacacgaccgtaggaaacgaccggacggaacacgagcccaagtgttaatttagttaggtaacctaagtttaacgggaacctaacgttaacgtacggttacccccggtagggggacccgtaacgggggtaaacccccttccggtacccgtaaaccccggtttcccttaccccgttaccgaccggtacccccttacccgaaaccccggaaaccgggggtcccccctaaacggtttccccgggttacccccgtttcccccccggtcggggacccccgtttccccccgg

SEQ ID NO: 361812 - DNA, 557 bp, Homo sapiens
  misc_feature: GZ8MTXP02HKLBT.3.23.C01.1.454.CMB.2.raw
  modified_base (242)..(242): a, c, t, g, unknown or other
  modified_base (301)..(301): a, c, t, g, unknown or other
  modified_base (392)..(392): a, c, t, g, unknown or other
  modified_base (465)..(465): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtctgggggaggcttggtgcaggccgggtgggtccctgcgactctcctgtgcaatttctgaacgccccttcaatacagtgtggatgaattgggtccncaggctcgagggaggggctggagtggtgcataataaaagtagactgctggtgagacaanagactacgctgctgccttcagaggcagacttcacctatcccgttacagagatagaatcacagagcactcttagtttcagacaaatgaaacngcctaggaacgacgacggaacacacgccaatcgttaattagtttgtaactagttagactacgtatacgtccgngggaccaacgggaccctcgtccaccgttctcctacgacgccctaccgacccgaacggccacgtccggtcccttcccccgcggcccgtacccg

SEQ ID NO: 361813 - DNA, 525 bp, Homo sapiens
  misc_feature: GZ8MTXP02IAKK2.3.23.C01.1.454.CMB.2.raw
  modified_base (293)..(293): a, c, t, g, unknown or other
  modified_base (300)..(300): a, c, t, g, unknown or other
  modified_base (319)..(319): a, c, t, g, unknown or other
  modified_base (516)..(516): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgcaggctccgagggagggctggagtggttggcatataaaaagtagactgctggtnagacaanagactacgctgctgccttnagaggcagattcaccatcctcagagatgaatcacagagcactctgtttctgacaaatgaacagcctaggaaagacgcgaacacagccatgtattattgtactattagacactatagtcccgtggggccaaggggaacccctcggtccaccgtctccctcacgccctccacgaacggcccagtccggtcctcccccgnggcctcccg

SEQ ID NO: 361814 - DNA, 552 bp, Homo sapiens
  misc_feature: GZ8MTXP02F0WTN.3.23.C01.1.454.CMB.2.raw
  modified_base (203)..(203): a, c, t, g, unknown or other
  modified_base (274)..(274): a, c, t, g, unknown or other
  modified_base (318)..(318): a, c, t, g, unknown or other
  modified_base (340)..(340): a, c, t, g, unknown or other
  modified_base (350)..(350): a, c, t, g, unknown or other
  modified_base (353)..(353): a, c, t, g, unknown or other
  modified_base (365)..(365): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcaggccgggtgggtccctgcgactctcctgtgcaatttcngaacgccccttcaatacagtgtggatgaattgggtccgcaggctcgagggagggctggagtgggtgcatanaaaagtagactgctggtgagacaacagactacgctgctgccttnagagcagatcacatcctcaganatgaatcacngancactctgtttcngacaaatgaacagcctaggaacgacgcgaacacagccatgttaattagttagtactagttacgactactatacgtcccgtggggaccctacgggaaccctcgtaccacccgtctcctactacgaccctcccaaaccgaacgggacccctacgtccccgggttaccttcccccgtggccccgtccccg

SEQ ID NO: 361815 - DNA, 657 bp, Homo sapiens
  misc_feature: GZ8MTXP02IG0HK.3.23.C01.1.454.CMB.2.raw
  modified_base (242)..(242): a, c, t, g, unknown or other
  modified_base (326)..(326): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactggtggcgtctgggggaggcttggtgcaggccgggtgggtccctgcgactctcctgtgcaatttctgaacgcccccttcaatacagtgtggatgaattgggccncaggctcgaggggagggctggagtggtggccataataaaagtagactgctggtgagaacaacagactacgctgctgccttcagnggcagactcactatcctacagagatagaatcacagacgcctaacttcttacgtttctagaactaaatacgaaacgtacgacgtaggaaacgaccggacggaaccacgacgacctaagttacgttaatttaagtttagtaagtaacgttaacgacctaaacgttaagttaaccggtcccggtacggggtacccgtaaccgggtaaacccccgttcggtacccctacccggtaccttcccgtaccgtaccgtccccttacccgaaacccgaaccgggtcccctaaccggttccccggttacccccgtttcccccgtccggtccccgtcccccg

SEQ ID NO: 361816 - DNA, 637 bp, Homo sapiens
  misc_feature: GZ8MTXP02H54BO.3.23.C01.1.454.CMB.2.raw
  modified_base (248)..(248): a, c, t, g, unknown or other
  modified_base (265)..(265): a, c, t, g, unknown or other
  modified_base (293)..(293): a, c, t, g, unknown or other
  modified_base (311)..(311): a, c, t, g, unknown or other
  modified_base (329)..(329): a, c, t, g, unknown or other
  modified_base (381)..(381): a, c, t, g, unknown or other
  modified_base (390)..(390): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactggtggcggtctggggggaggcttgggtgcaggccggggtgggtccctgcgactctcctgtgctaatttctgaacgcccccttcaaatacagtgtggatgaattgggccncaggctcgagggagggntggagtggtggccaataataaaaagtanactgctggtgaagacaanagactacgctgctgcctnagagcagatcacatcctacagagatgaatcacagagccacttcttgtttacngactaaaanagtaacacgccgtagggaaacgacggacggaacaacgagaccaattagttaatttaagttagtaaacagtttaacggaactaacttaacgtaccgtcccggtacgggggaccaaccgggggtaaacccctcggtaccctaacccggtccttcccgaccgaccgtccctacccgaaaccccgaaccggggtccccctaacggttcccccggtaccccgtttccccccggcggttacccccgtcccccg

SEQ ID NO: 361817 - DNA, 540 bp, Homo sapiens
  misc_feature: GZ8MTXP02HDGUC.3.23.C01.1.454.CMB.2.raw
  modified_base (202)..(202): a, c, t, g, unknown or other
  modified_base (239)..(239): a, c, t, g, unknown or other
  modified_base (290)..(290): a, c, t, g, unknown or other
  modified_base (501)..(501): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggagcttggtgcaggccgggtgggtccctgcgactctcctgtgcaatttcngaacgccccttcaatacagtgtggatgaattgggccncaggctccgagggagggctggagtggtgcataataaaagagactgctggtnagacaacagactacgctgctgccttcagaggcagattcaccatcctacagagatgaaactcacgagaacgcctacgtcttgtttccagactaaaatcggaaacagcctagggaaacgacgacggacaacgagtccaatgtattagttagtactagttaggactacgtatacgtccgtggggaccagggaaccctcgcaccgtctactcacncctccacgaacggccacgtccgtcctcccgcgcctcccg

SEQ ID NO: 361818 - DNA, 674 bp, Homo sapiens
  misc_feature: GZ8MTXP02JR4HM.3.23.C01.1.454.CMB.2.raw
  modified_base (284)..(284): a, c, t, g, unknown or other
  modified_base (320)..(320): a, c, t, g, unknown or other
  modified_base (361)..(361): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtcgtggggggaggcttgggtgcagccgggtgggtccctgcgactctcctgtgcaatttctgaacgccccttcaatacagtgtggatgaattgggtccgccaggctcagggagggctggagtggtgcataataaaagtanactgctggtgagacaacagactacgctgctgccttnagaggcagattcacctatccttacagagatagaatcacganacgtcctactcttgtttcctagacgtaaaagtacgaaacgacggacccgtagggaaaacgacggacggaaaccacgacgacctaagtgtttaaattattaggtaactagtttaacgaacttaacgttaagtaccgggtacccgttagggggaaccccgtaacgggggtaaacccccttcccggtaccggtaacccgttcccgtacccttcccgaccgttaccccctacccgaaacccctaacgggggacccccctaaacggtttccccggggttacccccttcccccccggtaggggttccccccgtcccccg

SEQ ID NO: 361819 - DNA, 552 bp, Homo sapiens
  misc_feature: GZ8MTXP02FXUNZ.3.23.C01.1.454.CMB.2.raw
  modified_base (202)..(202): a, c, t, g, unknown or other
  modified_base (238)..(238): a, c, t, g, unknown or other
  modified_base (320)..(320): a, c, t, g, unknown or other
  modified_base (328)..(328): a, c, t, g, unknown or other
  modified_base (333)..(333): a, c, t, g, unknown or other
  modified_base (341)..(341): a, c, t, g, unknown or other
  modified_base (368)..(368): a, c, t, g, unknown or other
  modified_base (409)..(409): a, c, t, g, unknown or other
tcagagacgcactccacgaccggtgctcgatttagtacacgtgatcaggactgaacacagaggactcaccatggactttgggctgaggtggattttccttgctgccatttttaaaaggtttccactgtgagctgcgactggtggcgtctgggggagcttggtgcagccgggtgggtccctgcgactctcctgtgcaatttcngaagccccttcaatcagtgtggatgaattgggtccncaggctccgaggggaaggggctggagtgggttggcatataaaagtagactgctggtgagacaacagacacgctgctgccttnagagcagntcacntctcaganatgaatcacagacgcactcttgtttcngactaaatgaaacagcctaggaacgacggacggacacgacnccatgttattacttgtactattaagacacttagtacgtccgtcggggaccgacgggtaaccctcgtacgtaccgtcctcctcgacgtccctccgaaccgaaccggtcccacgttccggtccctttcccccgcgcccgtccccg

SEQ ID NO: 361820 - DNA, 660 bp, Homo sapiens
  misc_feature: GZ8MTXP02G0U25.3.23.C01.1.454.CMB.2.raw
  modified_base (240)..(240): a, c, t, g, unknown or other
  modified_base (344)..(344): a, c, t, g, unknown or other
tcagagacgcactccacgaccggtgctcgatttagtacacgtgatcaggactgaacacagaggactcaccatggactttgggctgaggtggattttcctgctgccattttaaaaggttccactgtgagctgcgactggtggcgtctgggggagcttggtgcaggccgggtgggtccctgcgactctcctgtgctaatttctgaacgcccccttacaatacagtgtggatgaattgggccncaggctcgagggagggctggagtggtgcatataaaagagactgctggtgagacaacagactacgctgctgccttcgagaggcagacttccaactatccccttanagaagatagaaactcacagacgctaacttccttaggtttactaagtaaaatcgaaacacggaccgtagggaaacgacgacggaacaacgacgaccagttagttaattagttagtaacttaagttaacggtaactaacgttaagttaaccggtccccggttacgggggaccccgtaaacggggtaaacccccgttcggtacccgtacccggtttcctaccccgttaccgacccggtacccttaccccgaacccggaaacggggtccccctacggtcccggttcccccttcccccggcggtccccgtacccgtcccgg

SEQ ID NO: 361821 - DNA, 609 bp, Homo sapiens
  misc_feature: GZ8MTXP02FHMXW.3.23.C01.1.454.CMB.2.raw
  modified_base (204)..(204): a, c, t, g, unknown or other
  modified_base (240)..(240): a, c, t, g, unknown or other
  modified_base (273)..(273): a, c, t, g, unknown or other
  modified_base (345)..(345): a, c, t, g, unknown or other
  modified_base (360)..(360): a, c, t, g, unknown or other
  modified_base (410)..(410): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcaggccgggtgggtccctgcgactctcctgtgcaattttcngaagccccttcaatacagtgtggatgaattgggccncaggctccagggagggctggagtgggtgcatanaaaagtagactgctggtgagacaacagactacgctgctgccttcgagagcagattcacctatcccttcaganatgaactcacagacnctactcttgtttcagactaaagtgaacagccgtaggaacgacgcggaacnctaacgcctaagtgtatttaagttagtaactaagttaggaacctaacgtaagttaaccggtcccgtagggggaccctaacgggggtaaaccccctcggtaccctaacccggttcctacccgttacaccggtccctacccgaaacccgtaacggggcccctaacgttcccgggtccctttcccccgcgggcccgtccccg

SEQ ID NO: 361822 - DNA, 629 bp, Homo sapiens
  misc_feature: GZ8MTXP02GXS61.3.23.C01.1.454.CMB.2.raw
  modified_base (279)..(279): a, c, t, g, unknown or other
  modified_base (324)..(324): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtcgtgggggaggcttggtgcaggccgggtgggtccctgcgactctcctgtgcaatttctgaacgccccttccaatacagtgtggatgaattgggccgccaggctccgagggaagggctggagtgggtgcataanaaaagtagactgctggtgaagacaacagactacgctgctgccttnagaggcagacttcaacctatcccgttacaaggacgattgaaatcacgaaagcgacctaaccttcgttgtttactagaactaaaaatgggaaaacaggaccctaggggaaaacgccggcggtaaacacgacgccaaagttcgttaatttagtttagactaacgttaggaactacgtaactacggccccgtagggggacccaaacgggggtaaccccctcgtccgtaaccgtccctcctacacccgccctaccgaaccccgaaagggtccccaacggttcccgtcccttaccccggtcgcccgcccc

SEQ ID NO: 361823 - DNA, 890 bp, Homo sapiens
  misc_feature: GZ8MTXP02FO30L.3.23.C01.1.454.CMB.2.raw
  modified_base (203)..(203): a, c, t, g, unknown or other
tcagagacgcactccacgaccggtgctcgatttagtacacgtgatcaggactgaacacagaggactcaccatggactttgggctgaggtggattttccttgctgcctattttaaaaggtttccactgtgagctgcgactggtggcgtcgtgggggagcttggtgcagccggggtggtccctgcgactctcctgtgcaatttcngaacgccccttccaatacagtgtggatgaagttgggtccgcaggctccgagggaggctggagtggtgccaatataaaagagactgctggtagagaacaacagactacgctgactgccttagaaggtggcaagtacttccgaactatccttacaggagtactagaactacacgaagacgtacctaacttcgttacgttttaccgtaaggtaaacctaaaacgttaacggaaaacccgttaacgggtaccccggttaaacgggggtaaaaacccggaacccggggtaacccgggtaaaacccgggtaaaaccaaacggggtaccccccgttaaaaggttttaaaccggtttaaacgtttttaaaaccggttttagtttaaaacccgttaaaagggtttaaaccgggtaaaaacccgtttaacgtttaaaacccggtttaaccccggggtttaacccccggtttacgggggggaaacccccgttaaaaccggggggtttaaacccccctttacccgggggttaaccccttaaacccccggtttccccttaacccccgggttacctaaccccgtacccccgtaacccccgtaaaccggttaaaacccgggggtccccccttaaaacggtttccccccggggtttacccccgttttcccccgggtacccggggtccccttaacccccccggg

SEQ ID NO: 361824 - DNA, 625 bp, Homo sapiens
  misc_feature: GZ8MTXP02G9KV4.3.23.C01.1.454.CMB.2.raw
  modified_base (205)..(205): a, c, t, g, unknown or other
  modified_base (228)..(228): a, c, t, g, unknown or other
  modified_base (243)..(243): a, c, t, g, unknown or other
  modified_base (296)..(296): a, c, t, g, unknown or other
  modified_base (321)..(321): a, c, t, g, unknown or other
  modified_base (337)..(337): a, c, t, g, unknown or other
  modified_base (348)..(348): a, c, t, g, unknown or other
  modified_base (357)..(357): a, c, t, g, unknown or other
  modified_base (369)..(369): a, c, t, g, unknown or other
  modified_base (543)..(543): a, c, t, g, unknown or other
tcagagacgcactccacgaccggtgctcgatttagtacacgtgatcaggactgaacacagaggactcaccatggactttgggctgaggtggattttccttgctgccattttaaaaggtttccactgtgagctgcgactggtggcgtctggggggagcttgggtgcaggccgggtgggtccctgcgactctcctgtgctaatttcngaacgccccttacaatacagtgnggatgaattgggccncaggctcgagggagggctggagtggtgcaataataaaagagctgctggagaanacaacagactacgctgactgcctanagagcagtactcactntccctagaganatgaatcanagtacgctactnttcgttcagacaaatagaacacgacgtagggaaacgaccggacggtaaaccacgtacgacctagttaagtaatttaagttcgaaattaacggttaacgaactacgtaacgttaccggtaccgtacgggggaccctaaacgggtaccccttacgggtccctacccggtttacccnccgtaccaccgtaccctaacccgaccggtaacccggtaccctaccggttcccgttaccccgttaccccggtcggccctcccg

SEQ ID NO: 361825 - DNA, 565 bp, Homo sapiens
  misc_feature: GZ8MTXP02HZ78E.3.23.C01.1.454.CMB.2.raw
  modified_base (241)..(241): a, c, t, g, unknown or other
  modified_base (297)..(297): a, c, t, g, unknown or other
tcagagacgcactccacgaccggtgctcgatttagtacacgtgatcaggactgaacacagaggactcaccatggactttgggctgaggtggattttccttgctgccattttaaaaaggtttccactgtgagctgcgactggtggcgtctgggggaggcttggtgcaggccgggtgggtccctgcgactctcctgtgcaatttctgaacgccccttcaatacagtgtggatgaattgggccncaggctcgagggagggctggagtggtgcatataaaagagactgctggtgagacaanagactacgctgctgccttcagaggcagatcacatcccttcagagatgaaatcacagagcactcttgtttactgacaaatcgaacacgacctagggaaacgacgacggacacagtccaatgtattattagtacaattagactatatcgtcccgtggggaccacgggaaccccttcgaccgtaccgtccttccctcaccgccctccccgaaaccgaaccgggtacccctaacgtcccggttacccttccccccgttggccccggtccccg

SEQ ID NO: 361826 - DNA, 539 bp, Homo sapiens
  misc_feature: GZ8MTXP01AX483.21.86.H09.1.454.CMB.2.raw
  modified_base (322)..(322): a, c, t, g, unknown or other
  modified_base (338)..(338): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgatatgcagtgtctgtgagaagtcgaaatggacatcactacagacccacgaagaatcagttcncctgcatttgcactcngtgactcccgacgacacggctgtctactattgtgtagacactaccacgacggggctccgacactccgaccccgtcggggggccagtcgaaccctacgtcaccgtcctacctctacgcctccaccgaacgggcccacgtccggttccttccccgtcggttccgcccgttcgcctccgaacggacgccgaccctccgaacgcg

SEQ ID NO: 361827 - DNA, 542 bp, Homo sapiens
  misc_feature: GZ8MTXP01CJZ22.21.86.H09.1.454.CMB.2.raw
  modified_base (159)..(159): a, c, t, g, unknown or other
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgatangcagtgtctgtgagaagtcgaatggacatcactacagacccacgaagatcagttctcctgctatttgctactctgtgacctcccgacacacggctgtactactattgtagtaagacactacccacgacggggcctccgacacctccgaccccgtcggggggccgacgggaccctacgtccaccgtctcctccacgcctccaccgacggcccacgttccggtcccttccccgtcggccgcccgttcgcctccgacggcgccaccgttccgaacgcgccg

SEQ ID NO: 361828 - DNA, 551 bp, Homo sapiens
  misc_feature: GZ8MTXP01BBJDS.21.86.H09.1.454.CMB.2.raw
  modified_base (264)..(264): a, c, t, g, unknown or other
  modified_base (320)..(320): a, c, t, g, unknown or other
  modified_base (456)..(456): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgatangcagtgtctgtgagaagtcgaatggacatcactacagacccacgaagatcagttcncctgctatttcgcactctgtcgacctcccgagacacggctgtctactattgtagtagacactacccacgacggggcctccacacctccgaccccgtcgggggaccgacgggaaccctacgtccacccgtctcctcncgtccctccgaccgacggcccacgttccggtcccttccccgtcggcccgcccgttcgccctccgacggcgccacccgttccgaacgcggaacccg

SEQ ID NO: 361829 - DNA, 585 bp, Homo sapiens
  misc_feature: GZ8MTXP01DUNNQ.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctggggaagacattctacaggtccagatggtattctgatatgcagtgtctgtgagaagtcgaatggacatcactacagacccaacgaagaatcagttcctcctgcctatttgctactctgtcgactacccgacgacacggctgtctactattagtagtaagacactcccgacgacggggctaccgacaccgtccgaacccccgtcggggggacccgaaccggggtaaccctacgtccgtaaccccgtcctcccgtaccaccgtccctacccgacccgaaccgggccctacgttcccggtcccttccccgtcggcccgttcccgttcgccgtccgacgcgccaccgttccgaacgcgaaccg

SEQ ID NO: 361830 - DNA, 589 bp, Homo sapiens
  misc_feature: GZ8MTXP01ARXLF.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggctgggaagcattcacaggtccagatggtattctgatatgcagtgtctgtgagagtcgaaatggacatcactacacgacccaacgaagaatcagttctccctgctatttcgctactctgtcgactcccgacacacggctgtctactattgtagtaagacactacccacgacggggcctaccgacacgtacccgaccccgttcggggggacccgacggttaccgaaccccgtacgtacccgtacccgtcctaccctcctaccgaccctacccgacccgtaaaccgggccccacgtcccggttcccgttcccccgtcggcccgccccttcggccctccgcggacgccgacccgtcccgaacgaaccg

SEQ ID NO: 361831 - DNA, 558 bp, Homo sapiens
  misc_feature: GZ8MTXP01D61T3.21.86.H09.1.454.CMB.2.raw
  modified_base (258)..(258): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcacaggtccagatggtattcngatatgcagtgtctgtgaagaagtcgaaatggacatcactacagaccccacgaagatcagttcctcctgctatttgctactctgtcgacctcccgacgacacggctgtctactattgtgtaagacatacccacgacggggctccgacactcgaccccgtcgggggaccgacgggaaccctacgcctaccgtcctcctaccacgtccctaccaccgaacgggccctacgttccggtcccttccccgtcggcccgcccgttcgccgtcccgacggtcgccgacccgttccgaacgcgaaccg

SEQ ID NO: 361832 - DNA, 541 bp, Homo sapiens
  misc_feature: GZ8MTXP01D0PD7.21.86.H09.1.454.CMB.2.raw
  modified_base (356)..(356): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattatgcagtgtctgtgagaagtcgaatggacatcactacagaccaccgaagaatcagttctcctgcatttgcactctgtgactcccgacgacacggctcgtctactattgtgtaaagacntcccacaggggctccacactcgaccctgggccacgggaaccctagtcaccgtctcctcacgcctccaccaacgggcccactcggtccttccccgtcggccgccctcgcctccaggacgccacctccgacgacgcacgacgccggcccgttcgggctgcctcggtcacggactaacgttccgaacg

SEQ ID NO: 361833 - DNA, 570 bp, Homo sapiens
  misc_feature: GZ8MTXP01EPGRS.21.86.H09.1.454.CMB.2.raw
  modified_base (160)..(160): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcacgtccccgtgagaggccttgagtggctgggaagcattctacaggtcagatggtattctgatatgcagtgtctgtgagagtcgaatggacatcaactacagaccccaacgaagatcagttctccctgctatttgctactctgtcgactcccgacgacacggctgtactactattgtagtaacgacactacccagacggggctaccacacgtcccgaccccgtcgggggaccacggggtaaccctacgtaccaccgtcctcctacacgtccctacccgaaccgaacgggccctaacgttccgggtccccttccccgtcgggcccttcccgttcgcctccgacggccgtccaccgttccgaacgcgaacccg

SEQ ID NO: 361834 - DNA, 569 bp, Homo sapiens
  misc_feature: GZ8MTXP01EIY2U.21.86.H09.1.454.CMB.2.raw
  modified_base (194)..(194): a, c, t, g, unknown or other
  modified_base (298)..(298): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattcacaggtccagatggtattctgattangcagtgtctgtgagaagtcgaaatggacatcactacacgacccacgaagatcaagttcctccctgctatttcgctactctgtcgactccgacgacacggctgtcttactattgtagtaagacactacccgacgacgggggctaccgaccacgtccgacccgtcggggccgaacgggaaccctacgtccgtaaccgtccgttccctccgacgccctacccacccgacgggccccaacgtccgtccttccccgtccggccgcccgttcgcccg

SEQ ID NO: 361835 - DNA, 548 bp, Homo sapiens
  misc_feature: GZ8MTXP01AJ1G0.21.86.H09.1.454.CMB.2.raw
  modified_base (159)..(159): a, c, t, g, unknown or other
  modified_base (170)..(170): a, c, t, g, unknown or other
  modified_base (240)..(240): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctanaggtccagatggtattctgatatgcagtgtctgtgagaagtcgaatggacatcactacagacccacgaagatcagttctcctgctatttgctactctgtcgacctcccgacgacacggctgtctactattgtagtaagacactacccgacgacggggctccacaccgtaccgacccgtcggggggaccgaacgggaaccctacgtccaccgtcctcctcaccgtccctacccaccgacggcccacgttccggtcccttccccgtcggcccgcccgttcgcctccgacggcgccaccttccgcgcgccg

SEQ ID NO: 361836 - DNA, 575 bp, Homo sapiens
  misc_feature: GZ8MTXP01BXXVU.21.86.H09.1.454.CMB.2.raw
  modified_base (159)..(159): a, c, t, g, unknown or other
  modified_base (170)..(170): a, c, t, g, unknown or other
  modified_base (257)..(257): a, c, t, g, unknown or other
  modified_base (262)..(262): a, c, t, g, unknown or other
  modified_base (320)..(320): a, c, t, g, unknown or other
  modified_base (470)..(470): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattcacaggtccagatggtattcngatangcagtgtctgtgagaagtcgaaatggacatcactacagacccacgaagaatcagttcncctgctatttgctactctgtcgacctcccgacgacacggtctgtctactattgtagtaagacactacccgacgacggggcctaccacaccgtaccgaccccgtcggggggacccgaacgggaaccctacgtaccgaccgtcctccctacnccgtccctccacccgaacgggcccacgttccggtccttccccgtcggtcccgcccgttcggccctccggacggaaccgcctacccgttccgaacgaacgaacccg

SEQ ID NO: 361837 - DNA, 537 bp, Homo sapiens
  misc_feature: GZ8MTXP01C5UTM.21.86.H09.1.454.CMB.2.raw
  modified_base (159)..(159): a, c, t, g, unknown or other
  modified_base (264)..(264): a, c, t, g, unknown or other
  modified_base (311)..(311): a, c, t, g, unknown or other
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctcttactcacctgcgacatctccgggganagtatctttatcaccactagtacttggaattggatcaggcagtccccgtgagaggccttgagtggctgggaagcattctacaggtccagatggtattctgattangcagtgtctgtgagaagtcgaaatggacatcatacagacaaacgaanaatcagttcnccctgccatttgctactctagtcgcctcccgaacgacacgggctgtactactattgtagtaagacatcccacgacggggctccacactccgaccccgtcgggccggacgggaaccgtacgtcaccgtctcctcacgcctccaccgacggccaactcgttcctccccgttcggccgcccgttcgcttcccgaacgcgccaccgccgacgcgcgaacg

SEQ ID NO: 361838 - DNA, 539 bp, Homo sapiens
  misc_feature: GZ8MTXP01BTDWL.21.86.H09.1.454.CMB.2.raw
  modified_base (159)..(159): a, c, t, g, unknown or other
  modified_base (170)..(170): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtcccgtgagaggccttgagtggctgggaagcattctacaggtccagatggtattctgatatgcagtgtctgtgagaagtcgaatggacatcactacagacccacgaagatcagtctcctgctatttgcactctgtcgactcccgagacacggctgtctactattgtagtagacatacccacgacggggctccgacacgtccgaccccgtcggggggccgacgggaacccgtacgtccaccgtcctcctcacgtcctccaccgaacggcccacttccggtccttccccgtcggccgcccgttcggcctccgacggcgccaccgttccgaacgcgaaccg

SEQ ID NO: 361839 - DNA, 679 bp, Homo sapiens
  misc_feature: GZ8MTXP01DH9X5.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcacgtccccgtgagaggccttgagtggcgtgggaagacattctacgaggtccagagtggtattcgtgatatgctagtgtctgtgaagaagtcgaaatggacatacactacacgaaccccaacgaaagtaactcgtaacgttcctaccctgaccttattttcgacctaaccttcgttcgtaaccggacccttaccccgggaaacgtacccgtaccggtcttacgtaccttacttagtttagtagtaacgactacgtacccgacggtacgggcctaccgactaccgtaccgaccccggtacggggggacccgtaaccgggtaacccgtacgtacccgtacccgtcctacccgtaccgaccgtcccgtacccgaacccgaaccgggtccctaaccgttcccggttccccgttccccgttccggccccgttccccgttcgttcccgtaaccgacggccgccgacccgttacgaacgccgaacccg

SEQ ID NO: 361840 - DNA, 547 bp, Homo sapiens
  misc_feature: GZ8MTXP01CDBMB.21.86.H09.1.454.CMB.2.raw
  modified_base (195)..(195): a, c, t, g, unknown or other
  modified_base (273)..(273): a, c, t, g, unknown or other
  modified_base (359)..(359): a, c, t, g, unknown or other
  modified_base (377)..(377): a, c, t, g, unknown or other
tcagtcgtcgctcgcacgaccggtgctcgatttagtgctatagacttgggtttggggggaagaggaagactgacggtcctgcccggactgggcctcccatggggtgtcctgtcgcaaatacagctgcagcagtccggtccaggactggtgaagccctcgcagaccctctcactcacctgcgacatctccgggganagtatcttatcaccactagtacttggaattggatcaggcagtccccgtgagagcttgagtggctgggaagcattctanaggtcagatggtattctgattatgctagtgtctgtagagaagtcgaatggacatcactacaccgacccacgaagaatcaagttccncctgctatttgcactctntcgactccgacgacgacggctgtctacttactgtagtaagacactacccgacgtacggggcctaccgactaccgtccgacccgtcgggccgacgggaaccctggcctaaccgtcttcctcacgcctccacgacggccaactccggtcctcccgtcgccgtccgttcgccg

SEQ ID NO: 361841 - DNA, 558 bp, Homo sapiens
  misc_feature: GZ8MTXP01DKU5T.21.86.H09.1.454.CMB.2.raw
  modified_base (159)..(159): a, c, t, g, unknown or other
  modified_base (170)..(170): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtcgagaggccttgagtggctgggaagcattcacaggtccagatggtattctgatatgcagtgtctgtgagaagtcgaatggacatcactacagaccccaacgaagaatcagttctccctgctattgcactctgtcgactcccgacacacggctgtctactattgtagtagacactaccgacgacggggctccgactacgtaccgaccccgtcggggggacccgacgggaaccctacgtccaccgtcctcctaccacgtcctccaccgaacggcccacgttccggttcccttccccgtcggcccgcccgttcgccgtcccgacggccgtccacccgttccgaacgaacgccg

SEQ ID NO: 361842 - DNA, 609 bp, Homo sapiens
  misc_feature: GZ8MTXP01BGQS4.21.86.H09.1.454.CMB.2.raw
  modified_base (159)..(159): a, c, t, g, unknown or other
  modified_base (170)..(170): a, c, t, g, unknown or other
  modified_base (580)..(580): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcacgtccccgtcgagaggccttgagtggctgggaagacattctacaggtccagatggtatctgatatgcagtgtctgtgagaagtcgaatggacatcaactacacgacccaacgaagatctagttcctcctgcctatttcgctactctgtcgacctcccgacacgacggtctagtctactattgtagtaagacactacccacggacggggcctccgactaccgtaccgaccccgtcggggggaccgtaaccggggaaccccgtagtacccgtacccgtcctccctaccaccgtccctacccgacccgaacggtccccgtaacgttccgggtccccgttcccccgtcggccccgttcccgttccgccgtcccgacgggaaccncccgacccgttacccggaacgcgaacccg

SEQ ID NO: 361843 - DNA, 538 bp, Homo sapiens
  misc_feature: GZ8MTXP01DV0IW.21.86.H09.1.454.CMB.2.raw
  modified_base (290)..(290): a, c, t, g, unknown or other
  modified_base (319)..(319): a, c, t, g, unknown or other
  modified_base (493)..(493): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgatatgcagtgtctgtgagaagtcgaatgganatcactacagacccacgaagatcagttcncctgctattgctactctgtgactcccgaagacacggctgtactactattgtgtaagacactacccacgacggggctccacactcgaccccgtcggggggccacgggaaccctagtccaccgtctcctcacgcctccaccgaacgggcccacgttcggtccttccccgtcggccncccgttcgaccctccgacggcgccaccttccgaacgaacgaaccg

SEQ ID NO: 361844 - DNA, 541 bp, Homo sapiens
  misc_feature: GZ8MTXP01BXYJ8.21.86.H09.1.454.CMB.2.raw
  modified_base (159)..(159): a, c, t, g, unknown or other
  modified_base (263)..(263): a, c, t, g, unknown or other
  modified_base (320)..(320): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagagccttgagtggctgggaagacattctacaggtccagatggtattctgatangcagtgtctgtgagaagtcgaatggacatcactacagacccacgaagaatcagttcncctgcatttgcactctgtcgacctcccgagacacggctgtctacttattgtataagacactacccacgacggggctccacacctcgaccccgtcggggggccgacgggaccctagtccaccgtctcctctcgcctaccaccgaacggcccacgttccggtccttccccgtcggccgccccgttcgcctccgacggaaccgcacccgttaccgcgcgaaccg

SEQ ID NO: 361845 - DNA, 580 bp, Homo sapiens
  misc_feature: GZ8MTXP01ECH8O.21.86.H09.1.454.CMB.2.raw
  modified_base (241)..(241): a, c, t, g, unknown or other
  modified_base (266)..(266): a, c, t, g, unknown or other
  modified_base (494)..(494): a, c, t, g, unknown or other
  modified_base (539)..(539): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctanaggtccagatggtattctgattagngcagtgtcgtgtagaagaagtacgaagtggacatacaactacacgaacccaacgaagatctacgttcctcctgctattcgctactctgtcgaccgtcccgacgacgacggtcttgttacttacttagttgtagtaacgacactacccgacggacgggcctaccgacaccgtaccgaccccggtacgggggacccgacggtaacccgtacgtccacccgtcctcctacncgtccctaccgaccgacgcctacgttccgtcccttcccgcgtccnccgttcgcctccgacggcgccaccgttaccgaacgcgaacg

SEQ ID NO: 361846 - DNA, 560 bp, Homo sapiens
  misc_feature: GZ8MTXP01EAJGK.21.86.H09.1.454.CMB.2.raw
  modified_base (460)..(460): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcacaggtccagatggtattctgatatgcagtgtctgtgagaagtcgaatggacatcactacagacccacgaagatcagttctcctgctattgctactctgtcgactcccgacgtacacggctgtctactattgtagtaagacactacccgacgacggggctccgacaccgtaccgaccccgtcggggggaccacgggaaccctacgtccaccgtcctccctcncgtccctaccaccgaacgggccctacgttccggtcccttccccgtcggccgcccgttcgccctccgacggaaccgccacccgttaccgaacgcgaacccg

SEQ ID NO: 361847 - DNA, 722 bp, Homo sapiens
  misc_feature: GZ8MTXP01CPVQQ.21.86.H09.1.454.CMB.2.raw
  modified_base (160)..(160): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctggggaagacattcacaggtccagatggtattctgatatgcagtgtctgtgagaagtcgaatggacatcactacacgaaccccaacgaagaatcacgtttctccccgtgacctagtttcgctacgttactgtcgaccctaccccgggacgtaccgaccgggtcttcgtaccttaacgttagttagttacgtaaacgtaacctaaccgttaccccgaacggtaccgggggtacccttacccgaacccaccgtacccggaacccccgggttacggggggaccccggtaaaccggggtaaccccgtaccggttacccgtaaccccggttcccttacccgtacccgtacccgtaccccgtaccccgaaacccgaacccgggtaaccccgtaaccggttccccgggttccccgttcccccgttcgggtccccgttccccgttccgcccgttaacccgacgggtccgacccgtacccgttacccgtaacggaacggaacccg

SEQ ID NO: 361848 - DNA, 535 bp, Homo sapiens
  misc_feature: GZ8MTXP01CWA2J.21.86.H09.1.454.CMB.2.raw
  modified_base (170)..(170): a, c, t, g, unknown or other
  modified_base (319)..(319): a, c, t, g, unknown or other
  modified_base (495)..(495): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttancaccactagtacttggaattggatcaggcagtccccgtgagaggccttgagtggctgggaagacattcacaggtccagatggtattctgatatgcagtgtctgtgagaagtcgaatggacatcactacagacccacgaagatcagttcncctgctatttgcactctgtgactcccgagacacggctgtctactattgtgtagacactacccacgacgggggctccacactccgaccccgtcggggggccgacgggaaccctacgtccaccgtctcctcacgtcctccaccgaacggcccacgttccggtccttccccgtcggccncccgttcgcctccgacggcgccaccgttccgaacgcgccg

SEQ ID NO: 361849 - DNA, 560 bp, Homo sapiens
  misc_feature: GZ8MTXP01BP84M.21.86.H09.1.454.CMB.2.raw
  modified_base (194)..(194): a, c, t, g, unknown or other
  modified_base (297)..(297): a, c, t, g, unknown or other
  modified_base (357)..(357): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagagccttgagtggctgggaagcattcacaggtccagatggtattctgattangcagtgtctgtgagagtcgaatggacatcactacacgacccacgaagaactcaagttccnccctgcctatttgctacttctgtcgactcccgacgacgacggctcgtctactattgtgtaagacactcccgacgacggggctccgaccaccgtccgaccccgtcgggccgtacgggtaccctacgtccaaccgtccttcctcacgccctccaccgacggcccaacgtccggtcccttccccgtcggccgtcccgttcgtcccg

SEQ ID NO: 361850 - DNA, 575 bp, Homo sapiens
  misc_feature: GZ8MTXP01D8EQR.21.86.H09.1.454.CMB.2.raw
  modified_base (196)..(196): a, c, t, g, unknown or other
  modified_base (301)..(301): a, c, t, g, unknown or other
  modified_base (515)..(515): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagacattcacaggtccagatggtattctgattangcagtgtctgtagagaagtcgaatggacatcaactacacgaccccaacgaagaactcaacgttcctccctgctatttcgctacttctgtcgactcccgacgacgacgtctagtctactattgtagtaagactactaccgacgacggggtcctaccgacaccgtccgacccgtacggggccgtacgggaccctacgtccaaccgtccttcctccncgccctccgaccgacggcccaacgtccgtcccttccccgtcggccgtcccgttcgtcccg

SEQ ID NO: 361851 - DNA, 568 bp, Homo sapiens
  misc_feature: GZ8MTXP01CEALP.21.86.H09.1.454.CMB.2.raw
  modified_base (159)..(159): a, c, t, g, unknown or other
  modified_base (354)..(354): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattcacaggtccagatggtattctgatatgcagtgtctgtgagaagtcgaaatggacatcactacagaccccacgaagaatcagttctccctgcctatttgcactctgtcgacctcccganaccacgggctgtctacttattgtagtaagacactacccacgacggggcctccacactccgaccccgtcggggggccgacgggtaaccctacgtccacccgtcctcctcacgtccctccaccgaacggcccacgttccggtcccttccccgtcggcccgccccgttcgcccgtccgacggaaccgccgacccgttaccggaacgaaccgaacccg

SEQ ID NO: 361852 - DNA, 607 bp, Homo sapiens
  misc_feature: GZ8MTXP01CSTTV.21.86.H09.1.454.CMB.2.raw
  modified_base (159)..(159): a, c, t, g, unknown or other
  modified_base (259)..(259): a, c, t, g, unknown or other
  modified_base (264)..(264): a, c, t, g, unknown or other
  modified_base (270)..(270): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattcngatangcagtntctgtgagaagtcgaatggacatcaactacagacccacgaagatcagttctcctgctatttgactacttctgtcgacctcccgaagtaccacggcttgtactacttagttgtagtaacgtacactcccgaacggacggggcctaccacaccgtaccgaccccgtcggggggacccgaacggggaaccctacgtaccacccgtacctccctaccgaccgtcccctacccgaacccgaaccgggcccctaacgttcccggttcccgttcccccgttcggccccgttccccgttcgcccgtcccgacggccgcccgacccgttaccggaacgcgaacccg

SEQ ID NO: 361853 - DNA, 567 bp, Homo sapiens
  misc_feature: GZ8MTXP01CBK1B.21.86.H09.1.454.CMB.2.raw
  modified_base (339)..(339): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggcttgagtggctgggaagcattctacaggtccagatggtattctgatatgcagtgtctgtgagaagtcgaatggacatcactacagacccacgaagatcagttcctcctgctatttgctactctgngacctcccgagacacggctgtctactattgtagtaagacactacccacgacggggtcctaccaccaccgtccgaccccgtcggggggcccgacggggaaccctacgtaccacccgtcctcccgtcacgtccctacccaccgaacgggccctacgttccggtcccttccccgtcggcccgttcccgttcgcctcccgacggcgcccgaccgttccggaacgcgaacccg

SEQ ID NO: 361854 - DNA, 621 bp, Homo sapiens
  misc_feature: GZ8MTXP01ES93F.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagaggccttgagtggctgggaagacattctacaggtccagatggtattctgattatgctagtgtctgtgagaagtcgaatggacatcaactacacgaccccaacgaagatcagttcctcctgctatttcgctactctgtcgacctacccgacgacacggtctgttactacttattgtagtaagacactacccgacggacggggcctaccgaccaccgtaccgaccccggtcggggggacccggtaaccggtaacccgtacgtcccgtacccgtccgtccgtacgcccgtcccacccgaaccggacccgccgtaccgttcccgttccccgttcccggcccggtccccgttcccgttccgacccgtaacggaccggaaccgacccgtaccgaaccgaacgaaccgaacccgg

SEQ ID NO: 361855 - DNA, 566 bp, Homo sapiens
  misc_feature: GZ8MTXP01EBFCU.21.86.H09.1.454.CMB.2.raw
  modified_base (197)..(197): a, c, t, g, unknown or other
  modified_base (302)..(302): a, c, t, g, unknown or other
  modified_base (428)..(428): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccggggganagtatctttatcaccactagtacttggaattggatcaggcagtccccgtgagagccttgagtggctgggaagacattctacaggtccagatggtattctgattangcagtgtctgtgagaagtcgaatggacatcactacacgacccaacgaagaatcaagttctcccgtgctatttcgctaacttctcgtcgactacccgacgacacggctagtctactatgtagtaaanacactacccggaacgaggggcctaccacaccgtccgacccgtcgggaccgacggaacctacgccaaccgtcttcctcttacgcctccaccgaccggccctaacgtccgtccttccccgcggcccgtcccgttcgcccg

SEQ ID NO: 361856 - DNA, 730 bp, Homo sapiens
  misc_feature: GZ8MTXP01ESYWU.21.86.H09.1.454.CMB.2.raw
  modified_base (160)..(160): a, c, t, g, unknown or other
  modified_base (259)..(259): a, c, t, g, unknown or other
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgtagcagtccggtccaggactggtgaagccctcgcagaccctctcactcacctgcgacatcgtccgggganagtatctttatcaccactagtacttggaattggatcaggcagtccccgtcgagagccttgagtggctgggaagacattcacaggtccagatggtattcngattangcagtgtctgtgagaagtcgaaatggacatcactaacacgaaccccaaccggaaagtaactcaacgtttcctacccctgtaccctaattttcgcctaactccgttagtacgaaccctccccggaacgacctacggggtccttacggttacttaaccttagtttacgttaaggttaaacgaactaaccgttaccccgaacggacgggggtaccttacccgaaccgacccgtaccccggaacccccggttccgggggaaccccgggtaaccgggggtaaacccccgttaaccggtaccccgtaacccggttcccgtccccttaccgaacccggtccctaccccgaacccgtaaaccgggccccgtaacgtacccggttccccgttcccccgttccggtccccgtccccgttccgccgttcccgaacggacgaacccgacccgtcccgacgtaacgaaccgaacccgg

SEQ ID NO: 361857 - DNA, 667 bp, Homo sapiens
  misc_feature: GZ8MTXP01BMQZC.21.86.H09.1.454.CMB.2.raw
  modified_base (327)..(327): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagaggccttgagtggcgtgggaagacattcacaggtccagatggtattctgatatgctagtgtctgtgagaagtcgaatggacatacaactacacgacccaacgaagatcagttcncctgactatttcgctacttctacgtcgacctcccgagaccacggtctgtactactattgtagtaacgacactacccgacgacggggcctaccgaccaccgtaccgaccccggtacggggggacccgtaaccggggtaaccctaacggtccgtaacccggtcccttcccgtacccgaccggtcccctacccgaaccccggtaaaccgggcccccgtaacggttccccgggttaccccttcccccggtccgggtccccgttcccccggttccggttccccgtaacccgaccggggtaacccgcccgaaccccgttacccggaacggaacccggaaccccggg

SEQ ID NO: 361858 - DNA, 557 bp, Homo sapiens
  misc_feature: GZ8MTXP01AVAL6.21.86.H09.1.454.CMB.2.raw
  modified_base (159)..(159): a, c, t, g, unknown or other
  modified_base (259)..(259): a, c, t, g, unknown or other
  modified_base (320)..(320): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctggggaagacattcacaggtccagatggtattcngatatgcagtgtctgtgagaagtcgaaatggacatcatacagacccacgaagatcagttcncctgctatttgcactctgtgacctcccgagacacggctgtctactattagtgtaagacactacccgacgacggggcctaccgaccactccgaccccgtcggggggcccgaacggggaaccctacgtccacccgtctcctccacgtccctccaccgaacgggcccacgttccggtccttccccgtcggtccgccccgttcgcctccgacggaacgccacccgttccgaacgcgaaccg

SEQ ID NO: 361859 - DNA, 631 bp, Homo sapiens
  misc_feature: GZ8MTXP01EKKFC.21.86.H09.1.454.CMB.2.raw
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtcccgtgagagccttgagtggcgtgggaagacattctacaggtccagatggtattctgatangctagtgtctgtgagagtcgaatgacatcaactacacgaacccaacgaagaactctaagttctccgtgctatttgctactctgtcgacctcccgacgacgacggtctgttactacttattagtagtaacgacactaccccgacggacggggtcctaccgacgaccgtaccgtaccccgtcggggggacccgaacgggtaaacccgttacgtacccgtacccgtcctccctaccgaccgtcccctaccgaacccgaaccgggtaaccctaccggttcccggttccccgttccccgtccggtcccgttccccgttcgacccgtccggacggtaaccgcccgtacccgttaccggaacgaacgaacccg

SEQ ID NO: 361860 - DNA, 587 bp, Homo sapiens
  misc_feature: GZ8MTXP01EHTV2.21.86.H09.1.454.CMB.2.raw
  modified_base (241)..(241): a, c, t, g, unknown or other
  modified_base (357)..(357): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggcattctacaggtccagatggtattctgattangcagtgtctgtgagagtcgaatggacatcactacagacccaccgaagaatcagttctccctgcatttgcactctgtgactccgacgacacggctcgtctactattgtgtaaagacnctcccacggaggggctccgacacgtcccgaccccgtcggggacccgacggggaaccctagtccacccgtctaccctcacgccctccaccgaacgggcccatccggtccttcccccgtggcccgcccctgcctccgacggaccgccacccgtccgacgcgccgacgacggccggcccgttcggggcctcggccgtcgggtacaacgggttacctaaccgttccggaaccgg

SEQ ID NO: 361861 - DNA, 566 bp, Homo sapiens
  misc_feature: GZ8MTXP01D4V0Z.21.86.H09.1.454.CMB.2.raw
  modified_base (195)..(195): a, c, t, g, unknown or other
  modified_base (358)..(358): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaaggacattcacaggtccagatggtattctgattatgcagtgtctgtgagagtcgaatggacatcactacacgacccacgaagatcaagttcnccctgctatttgctactctgtcgactccgacgacgacggctagtctactattgtagtaagacactaccgacgacgggggcctaccgaccaccgtccgacccgtcggggccgaacgggtaaccctacgtccaaccgtccttcctcttacgcccgtccaccgacgggcccaacgtccggtcccttccccgtcggccgtcccgttcgcccg

SEQ ID NO: 361862 - DNA, 596 bp, Homo sapiens
  misc_feature: GZ8MTXP01DYKAV.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgatatgcagtgtctgtgagaagtcgaatggacatcaactacagaccccacgaagatcagttctccctgctatttgctactctgtcgacctcccgacgacacggctgtctacttattgtagtaacgacactacccgacgacggggcctaccgaccaccgtaccgaccccggtcgggggggacccgtaacggggtaaccccgtacgtccctacccgtcctccctaccaccgtccctacccgacccgaaccgggcccctacgttccggttccccttcccccgtcggcccgttcccgttcgcccgtccgacggcgcccgacccgttccgaacgcgaacccg

SEQ ID NO: 361863 - DNA, 562 bp, Homo sapiens
  misc_feature: GZ8MTXP01AEGRQ.21.86.H09.1.454.CMB.2.raw
  modified_base (194)..(194): a, c, t, g, unknown or other
  modified_base (293)..(293): a, c, t, g, unknown or other
  modified_base (299)..(299): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattcngattangcagtgtctgtgagagtcgaatggacatcactacacgacccacgaagactcaagttcctccctgcctagtttcgctactctgtcgactccgacgacacggctacgtctactattgtgtaagacactacccgacgacggggcctaccgacaccgtccgacccgtcgggccgacgggaccctacgtcgaaccgtcttcctcgacgcctcccaccgacgggccctaacgtccgtcccgttccccgtcggccgtcccgttcgtcccg

SEQ ID NO: 361864 - DNA, 573 bp, Homo sapiens
  misc_feature: GZ8MTXP01EOI08.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtatctgatatgcagtgtctgtgagaagtcgaatggacatcaactacacgacccaacgaagatcagttctccctgctatttcgctactctgtcgacctcccggacgacacgggtctgtcttactacgttgtagtaagacactacccgacgacggggctaccgacaccgtaccgaccccgtcggggggaccgaacgggtaaccctacgtccacccgtcctcctacacgtccctaccgacccgaacgggccctacgttccggtcccgttccccgtcggcccgccccgttcgcctccgcgcgcacccgttcgaacgcgaacccg

SEQ ID NO: 361865 - DNA, 565 bp, Homo sapiens
  misc_feature: GZ8MTXP01C9ACL.21.86.H09.1.454.CMB.2.raw
  modified_base (196)..(196): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagcattcacaggtccagatggtattctgattatgcagtgtctgtgagaagtcgaatggacatcatacacgacccacgaagaatcaagttctccctgcctatttcgacctacttctgtcgacctcccgacgacacggtctgtctactattgtagtaagacactaccgacgaggggcctccacaccgtccgacccgtcggggcccgacgggaaccctcgtccaaccgtcttcctcacgtccctccaccgacggccctaacgtcccgttccttcccccgtcggcccgtcccgttcgtcccg

SEQ ID NO: 361866 - DNA, 637 bp, Homo sapiens
  misc_feature: GZ8MTXP01EBQUZ.21.86.H09.1.454.CMB.2.raw
  modified_base (161)..(161): a, c, t, g, unknown or other
  modified_base (348)..(348): a, c, t, g, unknown or other
  modified_base (405)..(405): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaacgccctcgcagacccctctcactcacctgcgacatctccgggganagtatctttatcaccactagtacttggaattggatcaggcacgtccccgtgagaggtccttggagtggcgtggggaaaggactattctacgaggtcccaagtatggttattctagattatgctagtgtctgtgaagagtgaatggacatacaactacacgaccccaacgaagatctagttcctcctnctattgcctactctgtcgacctcccgacgacacggtctgtactactattgtagtaanacactacccgacgacggggcctaccgacaccgtacccgaccccggtcggggggacccgtaacggggtaacccctacgtaccgtacccgtccttacccgtacctaccgcccctacccgaaccccgaaccggccccgtaccggttccccggttccccgtttcccccgccggtccccgttcccgttccgcccgtaacccgaacggtccgcccgacccgccgaacgaacgaacccg

SEQ ID NO: 361867 - DNA, 579 bp, Homo sapiens
  misc_feature: GZ8MTXP01A0ENI.21.86.H09.1.454.CMB.2.raw
  modified_base (195)..(195): a, c, t, g, unknown or other
  modified_base (360)..(360): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgattatgctagtgtctgtgagagtcgaatggacatcactacacgacccacgaagaatcaagttccnccctgcctatttgctactctgtacgactcccgacgacacggcttgtactactattgtagtaagacactaccgacgacggggcctaccgacaccgtccgaccccgtcggggaccgacggggtaacccctcgtccaacccggtcttccctccgaccgccctcccaccgaaccgggccctaacgtcccggtccttccccgtcggttcccgcccgttcgcccg

SEQ ID NO: 361868 - DNA, 809 bp, Homo sapiens
  misc_feature: GZ8MTXP01BB4T1.21.86.H09.1.454.CMB.2.raw
  modified_base (161)..(161): a, c, t, g, unknown or other
  modified_base (172)..(172): a, c, t, g, unknown or other
  modified_base (214)..(214): a, c, t, g, unknown or other
  modified_base (275)..(275): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaacgccctcgcagaccctctcactcacctgcgacatcgtccgggganagtatctttancaccactagtacttggaattggatcaggcacgtcccgtgagngtcttgagtggcgtagggaagactattcacgacggtccagtagttggtattcgtgtatagngctagtgtcgtgtagagaagtacgaagtcggacataccaactacaaccgaaccccaacgtaagaactctacgttcctcctgtactatttcgacctacttcgtagtccgacccgtacccggacgacgtaccggtcgttacttaccgttaacttagttacgtaacggtaacgtaaccgtacccgttaccccgaaccggggtaccggggtaccccttaacccgacccgtaaccccgttaccccggggtaccccccgggttaccgggggggggaacccccggtaaacccgggggttaaacccccgttaaccgggttaccccgttaaccccggttccccttaccccgttacccgaaccccggtcccccttaaaccccggtaaccccggaacccgggtaaccccgttaacccgtttccccgggtttaccccccgttccccccgggtcccgggtccccgttcccccggttcgttaccccggttaaccccggaacggcccgaccccgtaccccggttaccggtaaccggaaccgaaccccgg

SEQ ID NO: 361869 - DNA, 660 bp, Homo sapiens
  misc_feature: GZ8MTXP01CY7YM.21.86.H09.1.454.CMB.2.raw
  modified_base (194)..(194): a, c, t, g, unknown or other
  modified_base (204)..(204): a, c, t, g, unknown or other
  modified_base (306)..(306): a, c, t, g, unknown or other
  modified_base (391)..(391): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctgcagaccctctcactcacctgcgacatcgtcgggganagtatcttancacactagtacttggaattggatcgaggcacgtccccgtgagaggccttggagtgggctgggaagacattcaacgaggtccagtatggtattcagtattagngctagtgtactggtagagtaagtcgtaaatggaactatacgacttaacgaaccgaccccaacgaaataactccgtaagtttcccnccgtgtacctaagtttcgactacttcgtacgtacgtaccgttacccgaacgtacgacggtcgtacgttacttacgtacgttacgtacgtaacgtaactaccgtaccggaacggtacggggtacctacccgaacgtaccgtaccgacccggtacgggaccgtacggtaacctacgtaccgtaacccgtcttcccgtacgccgtaccctcccgaaccgttacggacccgtaacgtcccggtcctccccgtcgaccgtccgttcggtaaccc

SEQ ID NO: 361870 - DNA, 510 bp, Homo sapiens
  misc_feature: GZ8MTXP01A4J4S.21.86.H09.1.454.CMB.2.raw
  modified_base (447)..(447): a, c, t, g, unknown or other
  modified_base (450)..(450): a, c, t, g, unknown or other
  modified_base (490)..(490): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaagacattctacaggtccagatggtattctgatatgcagtgtctgtgagaagtcgaaatggacatcactacagacccacgaagaatcagttctcctgcatttgcactctgtgactcccgagacacgggctgtctactattgtgtaagacatcccacagggggctccacactcgacccctggggggccaggggaacccctagtcaccgtctcctcacnccnccaccaacggccacttcgtccttccccgtcgcgccgcgcncacgcgcnccnccgcgngcg

SEQ ID NO: 361871 - DNA, 743 bp, Homo sapiens
  misc_feature: GZ8MTXP01DS020.21.86.H09.1.454.CMB.2.raw
  modified_base (161)..(161): a, c, t, g, unknown or other
  modified_base (171)..(171): a, c, t, g, unknown or other
  modified_base (256)..(256): a, c, t, g, unknown or other
  modified_base (272)..(272): a, c, t, g, unknown or other
  modified_base (416)..(416): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaacgccctcgcagaccctctcactcacctgcgacatcgtccgggganagtatcttancaccatagtactggaattggatcgaggcacgtccccgtgagcggtccttgagtcggactaggggaagacattcacgaggtccagntggtattcgagtatangctagtgtctgtaggaagagtacgaagtcggaactagtaccactacgaacgtacccccaaggaagtactctaacgttcctccccgtagtacctagtttcgacctaacgttcgtagtcgacccgtaccccgaagaacgtaccggnttacggtacctacgttattagtagtaacgtactacgtacccgacggtacggggtcctaccgaacgtaccgtacccggtaccccggtacggggggggaacccctaacgggggtaaaccccttacggtacccgtacccgttccgttacccgtaaccgtaccgtaccccgtacccgtaacccggtaaccgggtaaccccttaacggttccccggttaccccgttacccccggttcgggtccccgttaccccgttcggttaccccgtaacccggaacgggtaacccgtacccgtaaccccgttacccggtaacggttaaccgtaaccccgg

SEQ ID NO: 361872 - DNA, 625 bp, Homo sapiens
  misc_feature: GZ8MTXP01DP9JM.21.86.H09.1.454.CMB.2.raw
  modified_base (159)..(159): a, c, t, g, unknown or other
  modified_base (399)..(399): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgatatgcagtgtctgtgagtaagtcgaaatggaacatacaactacacgaaccccaaccgaaagaactcagttcctccctgctatttcgctactcttgtcgacctacccgacgacacggtctgtactactattgtagtaanacactacccgacgacggggctcccacacctaccgaccccgtcggggggaccaacgggaaccctacgtccacccgtcctccctaccgacgtcccctacccgaccgaaccggggtccccaacggttcccggtaccccgttcccccgtccgggccccgttcccccgttcgccccgttaaccccgagggaacccgacccgtaccccgttaccggaacgaaccgaaccccg

SEQ ID NO: 361873 - DNA, 631 bp, Homo sapiens
  misc_feature: GZ8MTXP01EFOA9.21.86.H09.1.454.CMB.2.raw
  modified_base (196)..(196): a, c, t, g, unknown or other
  modified_base (302)..(302): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcacgtccccgtgagaggccttgagtggctgggaagcattctacaggtccagatggtattctgattangcagtgtctgtagagagtcgaaatggacatcactacacgacccacgaagatcaagttcctcccgtgactatttcgactactcgtacgtcgtacgtacccgacgacgacgtcttacgtacttacttagttgtacgtaacgactacgtacccggacggtacggggtcctacccgaccgtaccgtcccggtaccccggtacggggacccgaaccgggtaacccctacggtcccgtaacccgtccttcccgtacgaccgtcccgtacccgaccgaccggcccgtaaccgttcccggtccccttccccggtcggttcccgtcccgttcgtcccg

SEQ ID NO: 361874 - DNA, 578 bp, Homo sapiens
  misc_feature: GZ8MTXP01EGWV0.21.86.H09.1.454.CMB.2.raw
  modified_base (240)..(240): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattangcagtgtctgtgagaagtcgaatggacatcactacagacccaccgaagaatcagttctccctgcatttgcactctgtgactcccgacgacgcgctcgtctactatgtgtaaaagacaactcccacgacggggctccacactccgaccccgtggggccacgggaaccctacgtcaaccgtcctcctccacgccctccaaccgaacgggcccactccggtcccttcccccgtcggcccgcccgttcgcctccgacggacgccacccgtccgagacgcacgacgccggcccgttcgggcctcggccgtggtccaacgggacctaaccgttcccgaaccggg

SEQ ID NO: 361875 - DNA, 681 bp, Homo sapiens
  misc_feature: GZ8MTXP01B8GM6.21.86.H09.1.454.CMB.2.raw
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagagtcgaatggacatcactacagaacccacgaagaatcagttcctcctcgctattcgctactctgtcgacctcccgacgacgacgtctcgtactacttagtttgtagtaaaacgactaaccgtacccgaacgggacggggccctaccgaacctacccgtaccccggtaccccggtcgggggacccgaaccggggtaaaccccgtacgtacccgtaccccgttcctaccctaccgaccgtccccgtacccgaaccgaacccgggccccgtacgttcccggttccccttcccccgtcggccccgtccccgtcgtacccgtccgaacggtaccgccacccggtaaccgacgacgaccgaccggacgcccggcccggttcggcgtccggtcgtcggtaccgacggttaccgttaaccgttccggaaccgg

SEQ ID NO: 361876 - DNA, 594 bp, Homo sapiens
  misc_feature: GZ8MTXP01BBK17.21.86.H09.1.454.CMB.2.raw
  modified_base (160)..(160): a, c, t, g, unknown or other
  modified_base (265)..(265): a, c, t, g, unknown or other
  modified_base (329)..(329): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctggggaagcattctacaggtccagatggtattctgatangcagtgtctgtgagaagtcgaaatggacatcaactacacgaccccaacgaaagactcagttccncctgctatttcgctactctgtgaccctcccgagacacggtctagtctacttattgtagtaacgacacgtacccgacgacggggcctaccgaccaccgtacccgacccccgtacggggggacccgtaacggggtaacccctacggtcccgtacccgtccgtaccctaccgaccgtccctacccgacccgaacgggcccctacgttcccggtcccttcccccgtcggcccgcccgttcgcctccgacgcgcctaccgccgcgcgccg

SEQ ID NO: 361877 - DNA, 535 bp, Homo sapiens
  misc_feature: GZ8MTXP01B1KTM.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaagacattctacaggtccagatggtattctgatatgcagtgtctgtgagagtcgaatggacatcactacagacccacgaagaatcagttctcctgctatttgcactctgtgactcccgagcacggctgtctactattgtagtagacactccacgaggggcctcacactcgaccccgtcggggggccacggggaaccctacggtccacccgtctccctcacgtcctcccgaccacgggcccagttccggtccttccccgtcggcccgcccgttgccctcgacggcgcacccgttccgcgaacgccg

SEQ ID NO: 361878 - DNA, 577 bp, Homo sapiens
  misc_feature: GZ8MTXP01DQJAV.21.86.H09.1.454.CMB.2.raw
  modified_base (262)..(262): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagagccttgagtggctgggaagcattctacaggtccagatggtattctgatangcagtgtctgtgagaagtcgaatggacatacactacacgacccaacgaagatcagttctcctgctatttgctactctgtcgacctacccgacgacacggctgtctacttattagtagtaagacactacccgacgacggggcctaccaccaccgtaccgaccccggtcggggggaccctaacggtaccgaacccgtacgtcccgtacccgtcctccctcaccgtccctacccaccgaaccgggcccaccgtccggttcccgttccccgtcggcccgcccgttcgcctccgaacgccgccaccgtccgaacgaaccg

SEQ ID NO: 361879 - DNA, 575 bp, Homo sapiens
  misc_feature: GZ8MTXP01B9OPG.21.86.H09.1.454.CMB.2.raw
  modified_base (159)..(159): a, c, t, g, unknown or other
  modified_base (262)..(262): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtcccgtgagagccttgagtggctgggaagacattctacaggtccagatggtattctgatangcagtgtctgtgagaagtcgaatggacatccaactacacgacccaacgaagaatcagttctcctgctatttgcactctgtcgactcccgagacacggctgtactactattgtagtaagacactacccgacggacggggcctaccgacactccgaccccgtcggggggaccgtaacgggaaccctacgtccaccgtcctcctaccgactccctaccacccgacgggcccctacgttcccggtcccttccccgtcggcccgttccccgttcgcccgtccgacggaaccgccgtacccgccgaacgaacgaacccg

SEQ ID NO: 361880 - DNA, 638 bp, Homo sapiens
  misc_feature: GZ8MTXP01BPBLB.21.86.H09.1.454.CMB.2.raw
  modified_base (160)..(160): a, c, t, g, unknown or other
  modified_base (268)..(268): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctaggggaagacattctacaggtccagatggtattctgattangctagtgtcgtgtagagtaagtcgaaatggactatacgaactacgaacgaaccccaacgaaagtaactccgtacgtttccctcccgtgtacctatttcgacctctacttgtccgtacctaccccggacgaccacgggtctcgttactacttagttaggtagtaacgactacgtacccgacggacggggcctaccgaccacgtacccgaccccggtcggggggaccgtacgggaacccgtacgtacctacccgtcctccgtcaccgtccctacccgaacccgacggcccctacgttcccggtcccttccccggtcggcccgttcccgttcgccgtccgacggtcgcccgaccgttaccggaacgcgaaccg

SEQ ID NO: 361881 - DNA, 520 bp, Homo sapiens
  misc_feature: GZ8MTXP01APK90.21.86.H09.1.454.CMB.2.raw
  modified_base (160)..(160): a, c, t, g, unknown or other
  modified_base (171)..(171): a, c, t, g, unknown or other
  modified_base (446)..(446): a, c, t, g, unknown or other
  modified_base (514)..(514): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagcatctttancaccactagtacttggaattggatcaggcagtcccgtgagaggccttgagtggctgggaagacattcacaggtcagatggtatctgattatgcagtgtctgtgagaagtcgaatggacatcactacagacccacgaagaatcagtctcccctgctatttgcaactctgtgactcccgacgacacggctgtctactattgtgtaagacactccacgacggggctccacactccgacccggtcggggccgacggaaccctgtccaccgtcctcctcncgcctccacaacggccacgtccgttcctccccgtcgccgcccttcgcctccgaacgcgcaccgtccgngaaccg

SEQ ID NO: 361882 - DNA, 667 bp, Homo sapiens
  misc_feature: GZ8MTXP01C1Z08.21.86.H09.1.454.CMB.2.raw
  modified_base (160)..(160): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtactggaattggatcaggcacgtccccgtgagaggccttgagtggcgtgggaaagacattctacagggtccagatggtattctgtatatgcagtgtctgtggagaagtcgaatggacatcaactacacgaaccccaacgaagaatcacgttcctcctgctatttgacctactctgtcgaccctacccgacgacgcggtctgtacttacttattgtagtaacgacaccgtacccgacgggacggggtacctacccacgtaccgttacccggaacccccggttacgggggggaccccgtaaaccgggggtaaacccctacggttaccccgtaccccggttcctaccccgtacccgaaccgtccccctaacccgaaccccggaaaccgggtccccctaacgttccccgggttccccttcccccggtcgggcccgttaccccgttcgcccgtccggacggccgacccacccgttaccgaacgccgaacccg

SEQ ID NO: 361883 - DNA, 581 bp, Homo sapiens
  misc_feature: GZ8MTXP01EIFNE.21.86.H09.1.454.CMB.2.raw
  modified_base (171)..(171): a, c, t, g, unknown or other
  modified_base (259)..(259): a, c, t, g, unknown or other
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcaggcagtccccgtgagagccttgagtggctgggaagacattctacaggtccagatggtattcngatangctagtgtctggtgagtaagtcgaatggacatcaactacagaccccaacgaagaatcagttctccctgcctatttgctactctgtcgacctccccgagaccacggtcctgtcctactattgtagtaacgacactacccacgtaggggcctccgacacaccgaccccgtcgggggaccgacgggaaccctacgtccgaccgtcctccctcacgtccctaccaacccgacgggccccacgttccccggtcccttcccccgtcggtcccgttccccgcgttccgtcccgagggccgccacccgccgaacgaacgaacccg

SEQ ID NO: 361884 - DNA, 553 bp, Homo sapiens
  misc_feature: GZ8MTXP01BS0O1.21.86.H09.1.454.CMB.2.raw
  modified_base (159)..(159): a, c, t, g, unknown or other
  modified_base (452)..(452): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctggggaagcattctacaggtccagatggtattctgatatgcagtgtctgtgagaagtcgaatggacatcaactacagacccacgaagaatcagttctcctgcatttgcactctgtcactcccgagacacggctgtctactattgtgtaagacactcccacgacggggctccgacactccgaccccgtcggggggaccgacgggaaccctacgtccaccgtctcctcncgtcctaccaccgaacgggcccacgttccggtccttccccgtcggcccgccccgttcgccgtcccgacggcgcccacccgttacccgaacgaaccgaaccg

SEQ ID NO: 361885 - DNA, 577 bp, Homo sapiens
  misc_feature: GZ8MTXP01AI7LC.21.86.H09.1.454.CMB.2.raw
  modified_base (260)..(260): a, c, t, g, unknown or other
  modified_base (568)..(568): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaagacattctacaggtccagatggtattcngatatgcagtgtctgtgagaagtcgaatggacatcactacacgacccaacgaagatctagttcctcctgctatttcgctactctgtcgacctcccgagaccacggtctgtactactatgtagtaagacactacccgacgacggggcctccgaccaccgtaccgaccccgtcggggggacccgaacgggtaaccctacgtacccaccgtcctcctaccaccgtccctacccgaacccgaaccgggccctacgttccggttcccttccccgtcgccgcccgttcgccctccgcggccgccgtaccgccgngaacgcccg

SEQ ID NO: 361886 - DNA, 573 bp, Homo sapiens
  misc_feature: GZ8MTXP01BMCRW.21.86.H09.1.454.CMB.2.raw
  modified_base (159)..(159): a, c, t, g, unknown or other
  modified_base (170)..(170): a, c, t, g, unknown or other
  modified_base (263)..(263): a, c, t, g, unknown or other
  modified_base (320)..(320): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctacaggtccagatggtattctgatangcagtgtctgtgagaagtcgaatggacatcactacagaccccacgaagatcagttcncctgcctatttgctactctgtcgacctcccgagacacgggctgtactactattgtagtaagacactacccgacgacggggcctaccgaccaccgtccgaccccgtcggggggacccgaacgggtaacccctacgtaccgacccgtcctcccgtcaccgtccctacccaccgaacgggccctacgttcccggtcccttccccgtcggcccgcccgttcgcctccgacggcgcccaccgttccgaacgcgaaccg

SEQ ID NO: 361887 - DNA, 558 bp, Homo sapiens
  misc_feature: GZ8MTXP01AJAI6.21.86.H09.1.454.CMB.2.raw
  modified_base (159)..(159): a, c, t, g, unknown or other
  modified_base (170)..(170): a, c, t, g, unknown or other
  modified_base (264)..(264): a, c, t, g, unknown or other
  modified_base (311)..(311): a, c, t, g, unknown or other
  modified_base (320)..(320): a, c, t, g, unknown or other
  modified_base (337)..(337): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacattctacaggtccagatggtattctgatangcagtgtctgtgagaagtcgaatggacatcactacagacccacgaanatcagttcncctgctatttgcactcngtcgacctcccgagacacggctgtctacttatgtgtaagacactacccgacgacggggctaccgacacgtaccgacccgtcggggggaccgaacggggtaaccctacgtccgaccgtcctcctacaccgtcctacccaccgaacggcccacgttccggtcccttccccgtcggccgccccgttcgcctccgacggcgccacccgttaccgaacgcgaaccg

SEQ ID NO: 361888 - DNA, 633 bp, Homo sapiens
  misc_feature: GZ8MTXP01CCGGC.21.86.H09.1.454.CMB.2.raw
  modified_base (160)..(160): a, c, t, g, unknown or other
  modified_base (268)..(268): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcacgtccccgtgagaggccttgagtggctagggaagacattctacaggtccagatggtattctgtatangcagtgtctgtgagaagtcgaagtggactatcaactacgacgaccccaacgaagactctacgttcctcctgactatttcgcctactcgtcgtcgacctacccgagaccacggtcttcgtacttacttagttagtagtaacgactacgtacccgacggacggggtccacccgaccgacgtcccgaccccggtacggggggacccgaacgggtaaccccgtacgtccgtacccgtccctccgtaccgccgtcccctacccgacccgaccgggtccctacgttcccggtccccttccccgtcggtcccgttccccgttcggttcccgtccggacgtccgaccctacccgttaccgaacgcggaacccg

SEQ ID NO: 361889 - DNA, 552 bp, Homo sapiens
  misc_feature: GZ8MTXP01B13HZ.21.86.H09.1.454.CMB.2.raw
  modified_base (133)..(133): a, c, t, g, unknown or other
  modified_base (144)..(144): a, c, t, g, unknown or other
  modified_base (237)..(237): a, c, t, g, unknown or other
  modified_base (243)..(243): a, c, t, g, unknown or other
  modified_base (266)..(266): a, c, t, g, unknown or other
  modified_base (355)..(355): a, c, t, g, unknown or other
  modified_base (370)..(370): a, c, t, g, unknown or other
  modified_base (477)..(477): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttancaccactagtacttggaattggatcaggcagtccccgtgagaggccttgagtggctgggaagcattcacaggtccagatggtattctgattangcagtntctgtgagaagtcgaatggacancactacagacccaccgaagatcagttctcctgcatttgctactctgtgacctcccgacgacgcgctcgtctactacttgtgtaaagacnctccacgacggggcnccacacgtccgacccgtgggccacgggacctagcaccgtctcctcacgcctccacgaacgggccacgttccggtccttccccgcgccgcccgtcgcctccgaaggcnccaccgtccgagcgccacgacggccgccgttcggcctcggccgtcggtacgacgggaccttccgttccgaaccgg

SEQ ID NO: 361890 - DNA, 775 bp, Homo sapiens
  misc_feature: GZ8MTXP01AX7O9.21.86.H09.1.454.CMB.2.raw
  modified_base (160)..(160): a, c, t, g, unknown or other
  modified_base (171)..(171): a, c, t, g, unknown or other
  modified_base (242)..(242): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcaggcagtccccgtgagaggccttgagtggctgggaagactattcanaggtccagatggtattctgatatgcagtgtctgtgagaagtcgaatggacatcaactacacgaccccaacgaagactcagttcctcctgctatttcgctactctagtcgaccctcccgaagaccgtacggctagtactacttagttgtagtaacgacacgtacccgaacggacggggtacctacccgaccgtaaccgtaccccggtaacccccgggttacggggggggaaccccggtaaaccgggggtaaaccccgttaccggtaccccgtaaccccggttcccgtaccccttacccgaacccggtccccttaacccccgtaaaccccggaaacccgggggtaacccccgttaaaccggtttacccccggggtttacccccgtttccccccccgggtttaccggggtaccccccgttccccccggttcccgggttcccccgttaacccccgggtaaaccggggtaaccccggtaacccccggaacccccggttacccccggggtaaaccggttaacccgggtaaacccccggg

SEQ ID NO: 361891 - DNA, 586 bp, Homo sapiens
  misc_feature: GZ8MTXP01D5V3Y.21.86.H09.1.454.CMB.2.raw
  modified_base (134)..(134): a, c, t, g, unknown or other
  modified_base (145)..(145): a, c, t, g, unknown or other
  modified_base (362)..(362): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccgggganagtatctttancaccactagtacttggaattggatcaggcagtccccgtgagaggccttgagtggctggggaagacattctacaggtccagatggtattctgattatgcagtgtctgtgagaagtcgaatggacatcactacagaacccacgaaagaatcagttctccctgctatttgcactctgtcgactcccgacacacggctcgtctactattgtagtaaagacnctcccacgacgggggctccactacgtccgaccccgtggggccaacggggaaccctacgtccaaccgtcctcctcacgccctccaccgaacgggcccacgtccgtccttcccccgtcggcccgcccgtgccctccgacggacgccacctccgacgacgcacgacgccggcccgttcgggcctggccctgggtaccgacggttacctaacccgttcccggaacggg

SEQ ID NO: 361892 - DNA, 618 bp, Homo sapiens
  misc_feature: GZ8MTXP01DR7YI.21.86.H09.1.454.CMB.2.raw
  modified_base (160)..(160): a, c, t, g, unknown or other
  modified_base (171)..(171): a, c, t, g, unknown or other
  modified_base (271)..(271): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcgaggcacgtccccgtgagaggccttgagtggcgtggggaaagacattctacgaggtccagatggtattctgatangcagtgtcgtgtgagaagtcgaaatggacagtaccaactacagaaccccacgaagatcagttcctcctagctatttcgactactcgtgtcgacctcccgaagaccacggtctacgttctacttattgtagtaagacactacccgaacgacggggacctccacaccgtaccgtaccccgtcggggggacccgaacggtaacccgtacggtacctccgtccgtcctaccgccgtccctacccaaccgaccggccctaacgttcccggttcccgttccccgtcggcccgttccccgttcgcccgtaacccgaacggtccgacccgtacccgaccgaacgaacgaacccgg

SEQ ID NO: 361893 - DNA, 596 bp, Homo sapiens
  misc_feature: GZ8MTXP01EXEPI.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcacaggtccagatggtattctgatatgcagtgtctgtgagaagtcgaatggacatcactacacgaccccaacgaagatcagttcctcccgtgctatttgctactctgtcgacctcccgacgaccgacggtctcgtactacttagttgtagtaacgactacgtacccgacggtacggggcctacccgaccaccgtaccgtaccccggtcggggggacccgacgggtaacccgtaccgtacgtcccaccgtcctacgtccgaccctcccgacccgaacggaacccgtaccgttccgtcccgttccccgtccggcccgcccgttcgttccgccgcgaacgaccgaccgaccgtcgcgaaccg

SEQ ID NO: 361894 - DNA, 602 bp, Homo sapiens
  misc_feature: GZ8MTXP01APK6H.21.86.H09.1.454.CMB.2.raw
  modified_base (159)..(159): a, c, t, g, unknown or other
  modified_base (263)..(263): a, c, t, g, unknown or other
  modified_base (270)..(270): a, c, t, g, unknown or other
  modified_base (322)..(322): a, c, t, g, unknown or other
  modified_base (340)..(340): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgatangctagtntctgtgagagtcgaatggacatcactacacgacccacgaagactcgagttcncctgctatttgcacttcngtcgacctcccggacaccgacggtctagtcctacttattgtagtaagacacgtacccgacgacggggcctaccacaccgtccgaccccgtcggggggacccgaacggggtaaccctacgtacccgtacccgtcctacccgtaccaccgtcccctacccgaacccgtaaccgggaacccctacgttcccggtccccgttccccgtccggtccgccccgttcgccctcccgacggaacgcccaccgttccgaacggaacgcccg

SEQ ID NO: 361895 - DNA, 537 bp, Homo sapiens
  misc_feature: GZ8MTXP01AJA9L.21.86.H09.1.454.CMB.2.raw
  modified_base (159)..(159): a, c, t, g, unknown or other
  modified_base (170)..(170): a, c, t, g, unknown or other
  modified_base (208)..(208): a, c, t, g, unknown or other
  modified_base (240)..(240): a, c, t, g, unknown or other
  modified_base (261)..(261): a, c, t, g, unknown or other
  modified_base (297)..(297): a, c, t, g, unknown or other
  modified_base (316)..(316): a, c, t, g, unknown or other
  modified_base (332)..(332): a, c, t, g, unknown or other
  modified_base (345)..(345): a, c, t, g, unknown or other
  modified_base (348)..(348): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgngagaggccttgagtggctgggaagcattcacnggtccagatggtatctgatangcagtgtctgtgagagtcgaaatggacatcactacngacccacgagatcagttcncctgcatttgcactcngtgacctcccganacncgggctgtctactattgtgtaagacataccacgacggggctaccgacactcgacccgtggggggccgacgggaaccctagtccaccgtctccgtcacgccctaccacccgaacgggcccacgttccgtccgttccccgtcggcccgcccgttcgcctccgacggaacgccaccgaccgaacgaacgccg

SEQ ID NO: 361896 - DNA, 591 bp, Homo sapiens
  misc_feature: GZ8MTXP01DFTWC.21.86.H09.1.454.CMB.2.raw
  modified_base (171)..(171): a, c, t, g, unknown or other
  modified_base (272)..(272): a, c, t, g, unknown or other
  modified_base (558)..(558): a, c, t, g, unknown or other
  modified_base (576)..(576): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcgaggcacgtccccgtgagaggccttggagtggcgtagggaagactattctacaggtccagtatggtattctgatangcagtgtctgtgaagaagtcgaatggacatacaactacacgaaccccaacgaagactctagttcctcctgctatttcgctactctgtcgacctacccgacgacgacgtcttgtacctacttagttgtagtaacgactacgtacccgacggacgggacctaccacctaccgtacccggaccccggtcggggggaccccgtaacgggtaaccctacgtaccgacccgttcctccgtaccaccgtccctaccgaccgacggccctacgttccgtcccttcccgcgcccnccgttcgcctcgacgccnccaccgcgcgcgccg

SEQ ID NO: 361897 - DNA, 686 bp, Homo sapiens
  misc_feature: GZ8MTXP01EOH8J.21.86.H09.1.454.CMB.2.raw
  modified_base (160)..(160): a, c, t, g, unknown or other
  modified_base (170)..(170): a, c, t, g, unknown or other
  modified_base (267)..(267): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatcttancaccactagtactggaattggatcagcacgtcccgtgagagcttgagtggctaggggaagactattctacgaggtccaagattggtattctagatangctagtgtctgtagagaagtcgaagtgacatacgaactacgacgaaccccaacgaagtaactctacgttcctccctagcctatttcgctacttactgtcgacctcccgaacgactacggtcttacgtacttacgttattagtacgtaacgacctaccgtacccgaacggtacggggacctacccgaacccgtacccgtacccggtacccccggtacggggggggtacccgaaaccggggtaaccccgtacgttaccccgtacccgtcccgttaccctaccgtaccgtccccgtaccccgtaacccggaacccgggtcccctaacgttcccggtccccgtttcccccgtccgggtcccttccccgttcgttcccgttaacgacggaaccgacccgacccttaccggaacgaaccgaaccg

SEQ ID NO: 361898 - DNA, 627 bp, Homo sapiens
  misc_feature: GZ8MTXP01DBNU5.21.86.H09.1.454.CMB.2.raw
  modified_base (160)..(160): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggcgtaggggaaggacattctacaggtccaagatggtattctgatatgctagtgtcgtgtgagaagtcgaatggacatacactacacgaccccaacgaagaatcagttctcctgcctatttcgactacttctgtcgacctccccgaacgacaccggtctcgttactacttattgtagtaacgactactacccgacggacggggtccctaccgactacccgtacccgaccccggtcggggggaccccgaacggggtaaaccccgttacgtacccgtacccggttcctcccgtaccgaccgtccctaccccgaacccgaacgggtccccaacgttcccggtcccttccccgtcggcccgcccgttcgcctccgaggaaccgccacccgttccgaacgaaccgaacg

SEQ ID NO: 361899 - DNA, 557 bp, Homo sapiens
  misc_feature: GZ8MTXP01EL5AP.21.86.H09.1.454.CMB.2.raw
  modified_base (159)..(159): a, c, t, g, unknown or other
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgatangcagtgtctgtgagaagtcgaaatggacatcactacagacccacgaagatcagttctcctgctattgcactctgtcgacctcccgagacacggtctgtactactattgtagtaagacactacccacgacggggcctaccacactccgaccccgtcggggggaccgacgggaaccctacgtccacccgtcctcctaccacgtccctaccaccgaacgggccctacgttccggtcccttccccgtcggcccgcccgttcgccgtccgacggcgccaccgttccgaacgcgaaccg

SEQ ID NO: 361900 - DNA, 648 bp, Homo sapiens
  misc_feature: GZ8MTXP01B6W41.21.86.H09.1.454.CMB.2.raw
  modified_base (160)..(160): a, c, t, g, unknown or other
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagacattctacaggtccagatggtattctgatangcagtgtctgtgagagtcgaatggacagtcaactacagaccccaacgaagaactcagttcctccctgtctatttgctactctgtcgacctcccgacgacacggctcgtactacttattagtagtaacgacactacccgacgtacggggtcctacccgaccgtaccgtacccggacccccggtacgggggggacccgtaaccggggtaaaccccgttacgtaccccgtaacccgttcccgtcccttacccgaccgtacccctaccccgaaacccggaaaccgggtccccgtaacgttcccgggttccccttcccccggttccggccccggttccccgttcggccctccgacggaacgcccgacccgttaccgaacgcgaacccg

SEQ ID NO: 361901 - DNA, 659 bp, Homo sapiens
  misc_feature: GZ8MTXP01ESFUF.21.86.H09.1.454.CMB.2.raw
  modified_base (159)..(159): a, c, t, g, unknown or other
  modified_base (170)..(170): a, c, t, g, unknown or other
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccatagtacttggaattggatcaggcagtccccgtgagaggccttgagtggctaggggaagacattcacaggtccaagatggtattctagatangcagtgtctgtagagaagtcgaatggacatcactacacgacccaacgaagatcagttctaccctgctatttcgcctacttcgtatcgtacctaccccgggaacgtaccacgggtctgtactacttattagtagtaagactactaccccgaacgacggggcctaccgaccaccgtacccgaccccggtcggggggacccgtaacggggtaaaccccgttaccggtacccgtacccgtccgtccccttaccgaccgtacccctaccccgaaccccgaaccggggaaccccctaacgttccccgggttccccgttcccccgtccggtccccggccccgttcggcccgtaacccgacggtaaccgacccgacccgttacccggaacgaacgaacccg

SEQ ID NO: 361902 - DNA, 690 bp, Homo sapiens
  misc_feature: GZ8MTXP01ELC0K.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagaggccttgagtggcgtggggaagactattctacaggtccagatggtattctgatatgctagtgtctggtgagagtacgaaagtggactatcaactacgaacgaaccccaacgaagtactctaacgttcctcctgcttatttcgcctacttcgtcgtcgtaccctccccggaacgtaccgtaccggtcttacgttacttaacttagttgtacgtaaacgactacgttaccccgacgggtacggggccctaccgaacccgacgtaccggaccccggtacggggggaccgaaaccgggtaacccctacggtaccctacccgttccctcccgtaccgaccgtacccgtaccccgaaccggaaacccggggtcccctaacggttccccgggttccccgttcccccgtccgggtaccccgttccccgttccgaccgtaacccgacggaacccgaccgtaccccacgggtaaccgcggaacccg

SEQ ID NO: 361903 - DNA, 580 bp, Homo sapiens
  misc_feature: GZ8MTXP01D70RY.21.86.H09.1.454.CMB.2.raw
  modified_base (197)..(197): a, c, t, g, unknown or other
tcagtcgtcgctcgcacgaccggtgctcgatttagtgctatagacttgggtttgggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagacatctacgaggtcagatggtattctgtattatgctagtgtctgtagagtaagtcgaaatggacatcactacacgacccacgaagactctaacgttctcccgtgctattcgctactctgtcgactccgacgacgacggtctcgtactactattgtagtaacgactactacccggacgacggggcctaccgacctaccgtccgacccgtacggggaccgtacggaccctacgtccaaccgtccttcctcacgccctaccaccgacggccctaacgtccggtcccttccccgcggcccgtccgttcgtcccg

SEQ ID NO: 361904 - DNA, 725 bp, Homo sapiens
  misc_feature: GZ8MTXP01AFNO3.21.86.H09.1.454.CMB.2.raw
  modified_base (160)..(160): a, c, t, g, unknown or other
  modified_base (171)..(171): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccatagtacttggaattggatcaggcacgtccccgtgagagccttgagtggcgtaggggaaagtactattcctaacgagggtcccagtagttgggttaattcgtaggtaattagtgactagttgtcgtggtagaagtaagtcgaaagtggactataccaactacaaccgaccccaacgaaagacttccgtacgttcctaccctgacttagtttcgacctactcttggtccacccgtacccgacgaccgtacgtctagtacctacttattagtacgtaacgaccacgtacccgacggacggggacctaccgaccgaccgtcccgacccggtacggggggacccgtaaccgggtaacccgtaccgtacccgtaacccgttccctacccgtaccgacccgtaccccgtaccccgaacccggaaccccgggtaaccccgtacccggttccccgggttcccccgtttcccccggtaccccgggtccccgttccccgttccgttcccgtaacccggacggaacccgacccgacccgttacccgaacgaaccgaacccg

SEQ ID NO: 361905 - DNA, 617 bp, Homo sapiens
  misc_feature: GZ8MTXP01CIDF5.21.86.H09.1.454.CMB.2.raw
  modified_base (158)..(158): a, c, t, g, unknown or other
  modified_base (592)..(592): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggganagtatctttatcaccactagtacttggaattggatcaggcagtccccgtgagaggccttgagtggctgggaagacattctacaggtccagatggtattctgatatgcagtgtctgtgagaagtcgaagtggacatcaactacacgaaccccaacgaagaatcaagttcctcccgtgcctatttcgactactccgttgtcgaaccctcccggaacgtaccacgggtctcgtactacttattagtagtaagacactacccgacgacgggctaccacaccgtaccgaccccgtcggggggaccctaacggtaccgaaacccgttacgtcccaacccgttcctacccttcaccgtacccctaccaacccgaaaccgggtcccttacgtcccggttccttcccccgtcggcccgcccgttccgccctccgaacgggccncccgttaccgtccgaacggaacccg

SEQ ID NO: 361906 - DNA, 589 bp, Homo sapiens
  misc_feature: GZ8MTXP01BDG40.21.86.H09.1.454.CMB.2.raw
  modified_base (159)..(159): a, c, t, g, unknown or other
  modified_base (170)..(170): a, c, t, g, unknown or other
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggcgtggggaagacattcacaggtccagatggtattctgatangcagtgtctgtagagaagtcgaatggacatcaactacagacccacgaagatcagttctcctgctattgctactctgtcgacctacccgacgacacggctgtctactacttgtagtaacgacactacccgacgacggggcctaccgacacgtaccgaccccggtacggggggaccgaacggggtaaccctacgtacccgtaccgtccctacctccgaccgtcccgtacccgaaccgaccgggccctacgttcccgggtccccttccccgtcggcccgttccccgttcgcctccgacggcgcccgccgttaccgaacgcgaacccg

SEQ ID NO: 361907 - DNA, 691 bp, Homo sapiens
  misc_feature: GZ8MTXP01DAJ96.21.86.H09.1.454.CMB.2.raw
  modified_base (160)..(160): a, c, t, g, unknown or other
  modified_base (171)..(171): a, c, t, g, unknown or other
  modified_base (269)..(269): a, c, t, g, unknown or other
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcgaggcacgtccccgtgagaggcttgagtggctgggaagctattcacgaggtccagtatggtattctagtatangctagtgtctgtagagaagtcgaatggacatcaactacacgacccaacgaanatcacgttctcctgctagtttcgctactctcgtcgacctacccggacgacgcggtcttcgtactacttagttacgtagtaaacgaacctacgtacccgacggtacggggtaccctacccgaaccgtaccgtaccccgggtaccccgggttacggggggaaccccggtaaccggggtaaaccccttaccggtacccgtaaccccgttcccgtcccgttacccgaccgtaccccgtacccgaaaccccgtaaccgggtcccctaacggttccccgggttccccttccccggtccgggtccccgttccccgttccgttacccgtcccgacggaacccgtcccgtacccgttaccggtaacgaacccgaacccg

SEQ ID NO: 361908 - DNA, 601 bp, Homo sapiens
  misc_feature: GZ8MTXP01BJIVD.21.86.H09.1.454.CMB.2.raw
  modified_base (160)..(160): a, c, t, g, unknown or other
  modified_base (268)..(268): a, c, t, g, unknown or other
  modified_base (339)..(339): a, c, t, g, unknown or other
  modified_base (551)..(551): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtcccgtgagaggccttgagtggcgtgggaagactattctacagggtccagatggtattctagatangctagtgtctggtagaagaagtcgaaatggactatacaactacaacgaaccccaacgaagatcacgttccncctgcctattcgctacgtctcgtcgacctcccggaagaccacgggtctacgtactactagttgtagtaagacacgtacccacggacggggcctaccgacaccgtaccgaccccggtacgggggacccgacggtaaccctacgtaccacccgtctccaccacgtccctaccaccgaaccggccctacgttccggtcccttccccgtcggcccncccgttcgccctaaccgcgaaccgcccaccgttaccgaacgaacgaaccg

SEQ ID NO: 361909 - DNA, 625 bp, Homo sapiens
  misc_feature: GZ8MTXP01DLTS5.21.86.H09.1.454.CMB.2.raw
  modified_base (295)..(295): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggcgtgggaaaggacattctacaggtccagatggtattctgatatgcagtgtctgtgagaagtcgaatgganatcaactacacgaccccaacgaagaatcacgttctccctgctatttcgctacttctgtcgacctcccgacgacgacggtctcgtactacttattgtagtaacgacacgtacccgacgacggggcctaccgaccaccgtcccgaccccggtcggggggacccgaacggggtaaacccctacggtacccacccgttcctcccgtaccgaccgtcccctacccgaccgaaccggtccctaccgttccggttccccgttccccgtccggtcccgttccccgttcgttacccgtaacccgaacggccgccctaccccgttcgaacgccgaacccg

SEQ ID NO: 361910 - DNA, 719 bp, Homo sapiens
  misc_feature: GZ8MTXP01CE7F0.21.86.H09.1.454.CMB.2.raw
  modified_base (197)..(197): a, c, t, g, unknown or other
  modified_base (309)..(309): a, c, t, g, unknown or other
tcagtcgtcgctcgcacgaccggtgctcgatttagtgctatagacttgggtttgggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatcttatcacactagtactggaattgatcaggcacgtcccgtgagaggtccttgagtgggctagggaagactattctacgaggtccagtatggtattcgtagtattagngcgtagtcgtcgtaggtagaaggtaacgtacgtaagtacggaactaactacctaactaacgaaaccccgaaaccccgaaacgtaaacgtaaactccgtaaaccgtttaccctcccgtagtacttactttacgaccttaactcgtacgtaccgtaccccgtaccggaaccgtaaccggacgttcgtacgttaaccttaagtttacgttagtaacgtaaacgtacgtaaccgtaccggaacgggtaccggggtacctacccgaacccgaccgtaccccggacccgggtaccgggacccgtaaccggtaaccctcgtacccgtcccgtccttccgaccgttccgaccctaccgaacccgcggaccctcggttacccgtccccttcccgcgggttccctcccgttcgtaacccg

SEQ ID NO: 361911 - DNA, 638 bp, Homo sapiens
  misc_feature: GZ8MTXP01DMIRW.21.86.H09.1.454.CMB.2.raw
  modified_base (159)..(159): a, c, t, g, unknown or other
  modified_base (265)..(265): a, c, t, g, unknown or other
  modified_base (328)..(328): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaaagacattctacaggtccagatggtattctgatangcagtgtctgtgagaagtcgaatggacatcaactacacgaaccccacgaaagatcgacgttcnccctagctatttcgcacttctgtcgacctcccgagaccacggcttgtactactagttgtagtaagacactacccgacgacggggctaccgacctaccgtacccgaccccggtcggggggacccgtaaccggggtaacccgttacgtcccgtaaccccgttcctcccgtaccaccgtaccccttacccgaacccgtaaacccgggtcccctaacgttcccggttccccgttcccccggtccggccccgttccccgttcgcccgtaacccgaacgggccgacccgtacccgttaccgaacggaacgaacccg

SEQ ID NO: 361912 - DNA, 584 bp, Homo sapiens
  misc_feature: GZ8MTXP01DNR1T.21.86.H09.1.454.CMB.2.raw
  modified_base (356)..(356): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagagccttgagtggcgtgggaaggactattctacaggtccagatggtattctgattatgctagtgtctgtagagagtcgaatggacatcactaccacggacccaacgaanaactcaacgttactccctgctattgcctacttcgtgtcgtaccgtcccgacgacgtacggtctagtctacttatgtagtaagacacgtaccgacggtacggggcctaccgacaccgtccgacccggtcgggaccgtacgggtaccctacgtccaacccgtccttcctcgacgccctccaccgacggccctaacgtccggtccctccccgtcgccgtccgttcgtcccg

SEQ ID NO: 361913 - DNA, 552 bp, Homo sapiens
  misc_feature: GZ8MTXP01B6KFO.21.86.H09.1.454.CMB.2.raw
  modified_base (159)..(159): a, c, t, g, unknown or other
  modified_base (450)..(450): a, c, t, g, unknown or other
  modified_base (525)..(525): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagatcagttctcctgcatttgcactctgtcgactcccgagacacgggctgtctactatgtgtaagacatacccgacgacggggctccacacgtccgaccccgtgggggccacgggaccctacggtccaccgtcctcctcncgtccctccacccgacggcccacgttccggtcccttccccgtcggcccgttccccgttcgcccgtcccgacggcncccgacccgttaccgaacgcgaacccg

SEQ ID NO: 361914 - DNA, 662 bp, Homo sapiens
  misc_feature: GZ8MTXP01DV5M5.21.86.H09.1.454.CMB.2.raw
  modified_base (634)..(634): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagagcttgagtggcgtagggaagacattctacgacggtccagattggtattcgtgattatgctagttgtctggtgaagtaagtcgaaagtcggacataccactaacacgaccccacgaaagatctagttcctcctgctattcgctacgtctcgtcgaccctacccgaacgtacgaccggtcttagttaccttacgttagttagtaacgtaacgaacctacgtaccccgaacggtacggggtaccctacccgaaccgacccgttacccgggaccccggttacggggggacccgaaccggggtaacccctacgtccctacccgtcctccctaccgacctcccgtacccgaaccgaacccgggtccctaacgttccccggtcccttcccccgcgggtcccttccccgttcgcccgtccgacgggcncccgtacccgaccggtcgaacgaacccg

SEQ ID NO: 361915 - DNA, 669 bp, Homo sapiens
  misc_feature: GZ8MTXP01BFOFL.21.86.H09.1.454.CMB.2.raw
  modified_base (160)..(160): a, c, t, g, unknown or other
  modified_base (241)..(241): a, c, t, g, unknown or other
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagcattctanaggtccagatggtattctgatangcagtgtctgtgagagtcgaatggacatacaactacacgaccccaacgaagactcagttcctccctgactatttcgacctacttcgtgtcgaccctccccggaacgacctaccgggtctacggttacttacttagttaggtacgtaacgactacgtacccgaacggtacgggggccctacccaccgtacccgtaccggaccccggttacggggggaccccgtaaccggggtaaccccgtacggttacccgtaacccggttccctacccgtaccgaccgtccccgtacccgaacccggaaaccgggtcccctacggttcccggttccccttcccccggtcggtccccgttcccgttccgcccgtaacccgacgggtaaccgcccgtacccgccgaacgcgaacccg

SEQ ID NO: 361916 - DNA, 672 bp, Homo sapiens
  misc_feature: GZ8MTXP01ADAUJ.21.86.H09.1.454.CMB.2.raw
  modified_base (160)..(160): a, c, t, g, unknown or other
  modified_base (171)..(171): a, c, t, g, unknown or other
  modified_base (262)..(262): a, c, t, g, unknown or other
  modified_base (267)..(267): a, c, t, g, unknown or other
  modified_base (273)..(273): a, c, t, g, unknown or other
  modified_base (383)..(383): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcgaggcacgtccccgtgagaggcttgagtggctagggaagctattcacgaggtccagatggtattcngatangcagtntctgtgagaagtcgaatggacatcaactacagacccaacgaagactcagttcctcctgacctatttcgacctacttcgtgttcgaccctccccggaagtaccaccgggtnttacgtacctacttagttgtaagtaacgacctacgtaccccgacggacggggtcctaccgaaccgtaccgtacccggaccccggttcgggggggacccgaaccgggggtaaccccttacggtacccgtaacccggttccctaccgtacccgaccgtcccctacccgaacccggaacccggggtcccctacggttccccggttcccccgttccccgtccgggtccccgttccccgttcgccccgtaacccggacggccgacccctacccgaccggaacgcggtaaccccg

SEQ ID NO: 361917 - DNA, 584 bp, Homo sapiens
  misc_feature: GZ8MTXP01B2OXR.21.86.H09.1.454.CMB.2.raw
  modified_base (360)..(360): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccacgaaagaatcagttctcctgcatttgcactctgtcgactcccgacgacacggctcgtctactattgtgtaaagacnctcccacgacggggctccacactcccgaccccgtggggccacgggaaccctagtccaccgtctcctcacgccctccaccgaacgggcccacgtccggtccttcccccgtcggcccgccccgtcgccctccgacggcgcctcccgccggacgacgccacgacggccggcccgttgggccgtcggcccgtcgggtcgaacggaccgttaaccgttcccgaaccggg

SEQ ID NO: 361918 - DNA, 729 bp, Homo sapiens
  misc_feature: GZ8MTXP01A7343.21.86.H09.1.454.CMB.2.raw
  modified_base (340)..(340): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagaggccttgagtggcgtggggaagactattctacgaggtccagatggtattctagattatgcaggtgtctgtaggagaagttcgaagtggacatcaactacacgaaccccacgaagaatctagttccnccgtgactattcgcctactcgtacgtcgaccctccccggaacgtaccgacgggtccttggtaccttacgttacgttaggttagtaaacgtacctaaccgttaccccgaacgggtacgggggtccctaccctaaccgacccgtacccggtaacccccggtcggggggaaccccgtaaaccgggggtaaccccttacggtacccgtaaccccgttcccgtacccgtacccgtaccgtccccgtaacccccgtaaccggaaacccgggtcccctaacggtttccccggggttcccccttccccccggtcgggtcccccgttccccggttcgccccgtaacccgaccgggaaccgtacccgtaccccgaccggtaaccggaaccggaaccccg

SEQ ID NO: 361919 - DNA, 686 bp, Homo sapiens
  misc_feature: GZ8MTXP01DI6HE.21.86.H09.1.454.CMB.2.raw
  modified_base (196)..(196): a, c, t, g, unknown or other
  modified_base (206)..(206): a, c, t, g, unknown or other
  modified_base (268)..(268): a, c, t, g, unknown or other
  modified_base (289)..(289): a, c, t, g, unknown or other
tcagtcgtcgctcgcacgaccggtgctcgatttagtgctatagacttgggtttgggggggaagaggaagactgacggtcctgcccgtactgggcctcccatggggtgtcctgtcgcaaatacagctgcagcagtccggtccaggactggtgaagccctgcagaccctctcactcacctgcgacatcgtccgggganagtatcttancaccactagtactggaattggatcagcagtcccgtgagagcttgagtggctggagcatcacngtcagatgtatctagtattangctagtgtctgtagagtaagtcgaagtggactatacaactacgaacccgaccccaacgaagtaactcgtaacttcctccgtgtacttatttcgcctacttcgtacgtaccgtaccgtacccgacgaccgtaccggtcttacgttacttaacgttagttacggtaacgtaaacgaacctaccgttacccgggaacggggtaccggggtaccctacccgaaccgtacccgtaccccggtaccccggtaccgggggacccgtaaaccgggtaaccctacgtcccgtaaccccgtccttacccgtaccgaccgtacccctacccgaacccggaccggaccccttaacggttccccggttaaccccgttccccggcggttcccgtccccgttcgtaaccccg

SEQ ID NO: 361920 - DNA, 767 bp, Homo sapiens
  misc_feature: GZ8MTXP01BNWLC.21.86.H09.1.454.CMB.2.raw
  modified_base (171)..(171): a, c, t, g, unknown or other
  modified_base (268)..(268): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcgaggcacgtccccgtgagaggccttgagtggctgggaagacattctacgaggtccagatggtattctgatangctagtcgtcgtgtaggaagtaaggtacgaaagtcggaacataccaacgtaaccgaacgaacccccaaacggtaaagtaaacttccgtaacgtttccctaccccgttagtcctaagttttcgcctaaccgtttcgtacgggttcgaacccgttacccccgggaaacgtaaccccgaccgggtacttcgttacccttaacgttagtttggtacgtaaacgtaaccacgttaccccgaacgggaacgggggtccctacccaaccgtacccgtacccggtaccccggggtcggggggtaaccccggtaaacccggtaacccgttacccgtacccgtaccccgtcccgtacccgtaccgaccccgtccccgtaaacccgacccgggaacccggtaacccgtacccggttcccgttcccccttacccgggccggtcccgttccccggttccgttacccgccggacgaaccgccccgacccgttacgggaaccaaccggtcccgg

SEQ ID NO: 361921 - DNA, 605 bp, Homo sapiens
  misc_feature: GZ8MTXP01CTG2I.21.86.H09.1.454.CMB.2.raw
  modified_base (196)..(196): a, c, t, g, unknown or other
  modified_base (293)..(293): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagacccctctcactcacctgcgacatctccgggganagtatcttatcaccactagtacttggaattggatcaggcacgtccccgtgagagccttgagtggctgggaagacattcacaggtcagatggtattcngattatgctagtgtctgtgagagtcgaatggacatcactacacgacccacgaagaactcaaacgttcctccctgtctaatttgactactctagtcgactacccgacgacacggctgtactatacttgtagtaacgtacacgtacccgacggtacggggcctaccgaacgtacccgtacccgaccccgtcggggaccgaacggggtaacctacgtacgtaacctacccggttcctacccgttcgtaccgtcccttacccgaccgaaccggtccctacgtccggttccctccccgttcggtcccgttccgtccg

SEQ ID NO: 361922 - DNA, 708 bp, Homo sapiens
  misc_feature: GZ8MTXP01BTTB8.21.86.H09.1.454.CMB.2.raw
  modified_base (196)..(196): a, c, t, g, unknown or other
  modified_base (206)..(206): a, c, t, g, unknown or other
  modified_base (302)..(302): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatcttancaccactagtactggaattggatcgaggcacgtccccgtgagagcttgagtggcgtgggaaggcatctacaggtccagtatggtattctagattangctagtgtctgtagagagtcgaagtggacagtcactacaccgacccacgaagtaactctaaacgttcctccctagtcctagtttcgactacttctcgtacgtaccgtacccggaacgacgtacggtcttacggttacttaacttagttaggtacgtaaagaacctaacgttaccccggaacggtacgggggtccttaacccgaccgtaacccgtcccggaaccccggtacgggggacccgtaaccgggggtaaccccttacgggtccctaacccggttccgttaccccgtaccgacccggacccttaccccgaaacccggaacccggggttccccgtaaccggttccccgggttaaccccgttttcccccggaccgggttccccggtcccccgttcggtcccccgg

SEQ ID NO: 361923 - DNA, 654 bp, Homo sapiens
  misc_feature: GZ8MTXP01BY70O.21.86.H09.1.454.CMB.2.raw
  modified_base (195)..(195): a, c, t, g, unknown or other
  modified_base (299)..(299): a, c, t, g, unknown or other
  modified_base (372)..(372): a, c, t, g, unknown or other
  modified_base (377)..(377): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtcaggactggtgaagccctcgcagaccctctcactcacctgcgacatcgtccgggganagtatcttatcacactagtacttgaattggatcaggcacgtccccgtgagaggccttgagtggctgggaagacattctacaggtaccagatggtatctgattangctagtgtctaggtgagtaagtcgaaagtggacatacgactacgacgacccaacgaagaatcgaaacgttccnccgtnacttattcgactactcgtacgtacgtaccgtaccgacgacgacgtctacgttacttacgttagttacgtacgtaaacgtaactaccgtaccggaacgggtacgggtacctaccgaaccgtacccgtacccggtacccggtaccgggaccgtaaccgggtaacccgtacgtacccgtaacccgtccttacccgtaccgaccgtaccctacccgaacccgaccggccccgtaacgttccccggtcccgttcccccgtcggcccgtcccgttccgtcccg

SEQ ID NO: 361924 - DNA, 649 bp, Homo sapiens
  misc_feature: GZ8MTXP01AP2T0.21.86.H09.1.454.CMB.2.raw
  modified_base (160)..(160): a, c, t, g, unknown or other
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccatagtacttggaattggatcaggcacgtccccgtgagaggccttgagtggctgggaagctattctacaggtccagatggtattctgatangctagtgtctgtgagagtcgaatgacatcactacacgacccacgaagatcagttcctcctgcatttgctactctgtcgaccctacccgacgaacgccgggtctacggtaccttacttagttaggtagtaacgaccacgtaccccgaacggacgggggtcctaccaccgtaccgtacccgaacccccggtcggggggaccccgtaacggggtaaccccgtaccgtcccgtacccggtccgtcccctaccgaccgtcccctaccccgaacccggaacccgggtccccaacgttccccggtccccgttcccccgtcgggccccgttcccgttccgcccgtaacccgacggaaccgacccgcccgttacccgaacgaaccgaacccgg

SEQ ID NO: 361925 - DNA, 593 bp, Homo sapiens
  misc_feature: GZ8MTXP01B2ECB.21.86.H09.1.454.CMB.2.raw
  modified_base (171)..(171): a, c, t, g, unknown or other
  modified_base (335)..(335): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcaggcagtccccgtgagaggccttgagtggcgtgggaagacattcacaggtccagatggtattcgtgtatatgctagtgtctgtgaagaagtcgaatggactatacaactacacgaaccccaacgaaagactcagttccncctgctattcgctactcgtcgtcgacctccccgacgacgcggtctgtacttacttagttgtagtaacgactactaccccgaacggacggggcctaccgaccaccgtcccgaccccggtcgggggacccgaaccgggaaccctacgtccgtaccgtcctccaccgctccctaccaccgaacggccctacgttcccgtcccttccccgtcggcccgcccgttcgcctccgacgaaccgccaccgttccgaacgcgaaccg

SEQ ID NO: 361926 - DNA, 596 bp, Homo sapiens
  misc_feature: GZ8MTXP01B7FNB.21.86.H09.1.454.CMB.2.raw
  modified_base (160)..(160): a, c, t, g, unknown or other
  modified_base (272)..(272): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagaggccttgagtggctgggaagacattcacaggtccagatggtattctgatatgcagtgtntgtgagaagtcgaatggacatcaactacacgacccaacgaagatcagttcctcctgactatttgctactctgtcgacctcccgacgacacggctgtactacttattgtagtaacgacactacccgacggacggggcctaccacaccgtccgaccccggtcggggggaccgaacgggtaccctacgtaccacccgtcctcctaccgccgtccctaccacccgaacgggccccacgttcccgggtcccttcccccggtcggtcccgttccccgttcgcccgtaacccgacggaaccgtcccgacccgttaccgaacgccgaacccg

SEQ ID NO: 361927 - DNA, 581 bp, Homo sapiens
  misc_feature: GZ8MTXP01C0QUV.21.86.H09.1.454.CMB.2.raw
  modified_base (135)..(135): a, c, t, g, unknown or other
  modified_base (146)..(146): a, c, t, g, unknown or other
  modified_base (267)..(267): a, c, t, g, unknown or other
  modified_base (345)..(345): a, c, t, g, unknown or other
  modified_base (360)..(360): a, c, t, g, unknown or other
  modified_base (499)..(499): a, c, t, g, unknown or other
tcagtcgtcgctcgcacgaccggtgctcgatttagtgctatagacttgggtttgggggggaagaggaagactgacggtccaggactggtgaagccctcgcagaccctctcactcacctgcgacatctccgggganagtatctttancacactagtacttggaattggatcaggcagtccccgtgagaggccttgagtggctgggaagcattcacaggtcagatggtattctgattatgcagtgtctgtgaagaagtcgaatggacancatacacgaaccaccgaagaatcagttctccctgcatttgctactctgtcgacctccgacgacacgctcgtcctactnttgtagtaaacgacnctcccacgacggggcctccgactacgtccgaccccgtgggacccgaacgggaaccctacgtaccaccgttcctcctcacgccctccaaccgaacgggcccacgtccggtccttccccgcgccgccctgcctccacggcnccaccgtccgaagcgccacgacgccggcccgttcgggcctcggtacccgtggtaccgacggttacctcccgttccgaaccgg

SEQ ID NO: 361928 - DNA, 553 bp, Homo sapiens
  misc_feature: GZ8MTXP01EBV1Y.21.86.H09.1.454.CMB.2.raw
  modified_base (133)..(133): a, c, t, g, unknown or other
  modified_base (241)..(241): a, c, t, g, unknown or other
  modified_base (363)..(363): a, c, t, g, unknown or other
  modified_base (479)..(479): a, c, t, g, unknown or other
  modified_base (489)..(489): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttatcaccactagtacttggaattggatcaggcagtccccgtgagaggccttgagtggctggggaaggacattctacaggtccagatggtattctgattangcagtgtctgtgagaagtcgaatggacatcactacagacccaaccgaagaatcagttctaccctgcatttgctactctgtgactcccgacgacgcggctcgtctactattgtagtaaagacncgtcccacgacggggctaccacactccgacccgtgggaccacgggaaccctacgtccaaccgtctcgtcacgccctccacgacgggccagtccgtccttcccctgccgccgcgtcnccgagcgtcncctcgacgcgcaacgcgtccggccgcgggctcggcctgtacgacggactaaccgttccggaacg

SEQ ID NO: 361929 - DNA, 616 bp, Homo sapiens
  misc_feature: GZ8MTXP01B3NHG.21.86.H09.1.454.CMB.2.raw
  modified_base (160)..(160): a, c, t, g, unknown or other
  modified_base (171)..(171): a, c, t, g, unknown or other
  modified_base (272)..(272): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcgaggcagtccccgtgagaggccttgagtggcgtagggaagactattctacgaggtccagattggtattctgtatangctagtgtctgtagagaagtcgaatggacatcaactacacgaccccaacgaagtatcagttcctcctgacctattgctactctgtcgacctcccgacacgacgctacgtctactagttagtagtaacgacacgtacccgacggacggggacctccgaccgaccgtacccgaccccggtcggggggacccgtaacgggtaacccgtacgtaccgtacccgtccctaccgtaccgaccgtccccgtacccgaccgaaccggcccctaacgttcccggttcccgttccccgtcggtcccgcccgttcgcccgtccgacggccgccgacccgttccgaacgcgaaccg

SEQ ID NO: 361930 - DNA, 771 bp, Homo sapiens
  misc_feature: GZ8MTXP01DWCJN.21.86.H09.1.454.CMB.2.raw
  modified_base (243)..(243): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccacttagtacttggaattggatcaggcacgtcccgtgagagcttgagtggcgtagggaagacattctanaggtccagatggtattctagtatatgctagtgtctgtagaagtaagtacgaaagtcggaactactacaacttaacaacgaaccccaaacgaagtaactacgtacgttcctcccgtagaccttagttcgaccgttacttccgttagtccgtacccgtacccggaacgtaccgtaccgtcgttacgttacttacgttagttacggtaacgtaaacgactaccgtaccccgaacgggtacggggtacctaccccgaaccgtaccccgtacccgggtacccccgggtacggggggtaccccggtaaaccgggggttaacccctaaccggtaccccgtaaccccggtttccctacccgttaaccccgacccgtacccccttaaccccggaaacccgggtaacccggggtccccctaacgggttcccccgggtttaccccttcccccggccggtccccgttccccgttcgttaccccggtaaccggaccggaacccgccgtaaccccgttccggtaacggaaccgtaaccccgg

SEQ ID NO: 361931 - DNA, 618 bp, Homo sapiens
  misc_feature: GZ8MTXP01A2MY8.21.86.H09.1.454.CMB.2.raw
  modified_base (158)..(158): a, c, t, g, unknown or other
  modified_base (169)..(169): a, c, t, g, unknown or other
  modified_base (263)..(263): a, c, t, g, unknown or other
  modified_base (331)..(331): a, c, t, g, unknown or other
  modified_base (345)..(345): a, c, t, g, unknown or other
  modified_base (581)..(581): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctgcagaccctctcactcacctgcgacatctccgggganagtatctttancaccactagtacttggaattggatcaggcacgtccccgtgagaggccttgagtggctgggaagctattcacaggtccagatggtattctgatangctagtgtctggtgaagtaagtcgaaatggacatcaactacacgacccaacgaagatcacgttctccngctattgctactcngtcgaacctcccgagaccgtacggtcttacgtactaacttagttacggtagtaaacgacctacgtacccgacggacggggcctaccgaccaccgtacccggaccccgtcggggggacccgtaacgggtaaccctacgtcccgtacccgtcctccctaccgacgtcccctacccgaaccgaccggcccctacgttcccggtcccgttccccgtcggccccgttcccgttcgttcccncccgagaaccgcccacccgttaccgaacgcgaacccg

SEQ ID NO: 361932 - DNA, 569 bp, Homo sapiens
  misc_feature: GZ8MTXP01ARW4V.21.86.H09.1.454.CMB.2.raw
  modified_base (160)..(160): a, c, t, g, unknown or other
  modified_base (171)..(171): a, c, t, g, unknown or other
  modified_base (262)..(262): a, c, t, g, unknown or other
  modified_base (268)..(268): a, c, t, g, unknown or other
  modified_base (543)..(543): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcaggcacgtccccgtgagagccttgagtgcgtgggaagcattcacaggtccagatggtatctgatangcagtntctgtagagaagtcgaatggacatcactacacgacccacgaagatcagttctcctgctatttgctactcgtgtcgacctcccggacacacggcttgtctacttattgtagtaagacactacccgacgtacggggcctaccacgtaccgtaccgaccccgtcggggggacccgaacgggtaaccctacgtccgaccgtccgtccctcgacgtcctaccgaccgaacggccctacgttccggtcccttccccgtcgccgccgttcgcctcgacggcnccaccgttaccgaacgaacgtaaccg

SEQ ID NO: 361933 - DNA, 668 bp, Homo sapiens
  misc_feature: GZ8MTXP01AY0GM.21.86.H09.1.454.CMB.2.raw
  modified_base (160)..(160): a, c, t, g, unknown or other
  modified_base (171)..(171): a, c, t, g, unknown or other
  modified_base (269)..(269): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtactggaattggatcaggcagtccccgtgagaggccttgagtggcgtaggggaagactattctacagggtccagatggtattctgatangctagtgtctgagagaagtgaatggacatcactacgacgacccaacgaagactcagttcctcctgctagtttgactactctgtcgacccgtcccgaacgtaccgcggtctcgtacttacttagttagtagtaacgacactacccgacggacggggacctaccgacctaccgtacccgtaccccgggtacggggggacccgtaaccgggtaaccccgtacggtacccgtaacccgttccctaccctaccgacccgtccccgtacccgtaacccggaaacccgggtcccctaaccgttccccggttccccgttccccccggtccgggtccccgttccccgttccggttaccccgtcccgaccggaaccgtacccgacccgacccggaacgaaccgaacccg

SEQ ID NO: 361934 - DNA, 719 bp, Homo sapiens
  misc_feature: GZ8MTXP01CR742.21.86.H09.1.454.CMB.2.raw
  modified_base (195)..(195): a, c, t, g, unknown or other
  modified_base (249)..(249): a, c, t, g, unknown or other
  modified_base (293)..(293): a, c, t, g, unknown or other
  modified_base (299)..(299): a, c, t, g, unknown or other
  modified_base (331)..(331): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctgcagaccctctcactcacctgcgacatcgtccgggganagtatctttatcacctactagtactggaattggatcaggcacgtccccgtgagnggccttgagtggctgggaagacattcacaggtcagatggtatcngtattngctagtgtcgtagtgaagtagtacgaatgganagtacactacaccgacccaacgaagtaactctaaacgttccctcccgtgtacctaagtttcgacctaaccgttctacgtaccgtacccgtacccgacgtacgaccgggtctacggttaccttaacttagttacgttacgtaacgtaacgtaccgtacccggtaacgggtacgggggtaccctacccgtaaccgtaccccgtacccggtaccccggttaccgggggaacccgtaacccggggtaaaccccgttaccgtacccgtaacccgttcccgttacccgttaccgaccggtacccccgtacccgaaaccccggaacccgggaccccgtaaccgttccccggttccccgttcccccggtccggccccgtcccgttccgtaaccccg

SEQ ID NO: 361935 - DNA, 628 bp, Homo sapiens
  misc_feature: GZ8MTXP01D7LYT.21.86.H09.1.454.CMB.2.raw
  modified_base (311)..(311): a, c, t, g, unknown or other
  modified_base (319)..(319): a, c, t, g, unknown or other
  modified_base (323)..(323): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggctgggaagacattcacaggtccagatggtattctgatatgctagtgtctgtgagagtcgaatggacatcactacagacccacgaanatcagtcncctnctattgctactctgtcgactcccgacacgacgtctgtctactattgtagtaacgtactactacccgacggtacggggcctaccgaccaccgtacccggaccccgtcggggggaccccgtacgggggtaaacccctacggtacccgtaaccccgttccttacccgtaccgtaccgtcccctacccgaacccgtaaccgggcccctacgttccccggttcccctttcccccgtccgggtcccgttccccgttcgttcccgtcccgacgggaaccgtcccgtacccgttccggaacgaacgtaacccg

SEQ ID NO: 361936 - DNA, 697 bp, Homo sapiens
  misc_feature: GZ8MTXP01CEEAF.21.86.H09.1.454.CMB.2.raw
  modified_base (159)..(159): a, c, t, g, unknown or other
  modified_base (212)..(212): a, c, t, g, unknown or other
  modified_base (240)..(240): a, c, t, g, unknown or other
  modified_base (330)..(330): a, c, t, g, unknown or other
  modified_base (340)..(340): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagnggccttgagtggctgggaagacattcanaggtcagatggtattctgatatgcagtgtctgtagagagtcgaatggacactacactacgacgacccgaacgaagtactcacgtttcccncgtcgacttntttcgactacctcgttgtaacgaccctacccggacgtacgacgggtcttagtccttactagttgtagtaagacgtactacccgacggcggggtacctaccgaccgtccgtacccggaccccgggttacgggggggaccccgtaaccggggtaaaccccgttacgtcccgtaacccggtccctaccgttaccgccgtaccccgtacccgaacccgggtaaccggggtccccctaacggttccccgggttccccgtttaccccccggtcgggtccccggttcccccgtttccgggcccctcccggtaaccggggaaccaccccgtaccggttaccccggtaacggcccgtaaccccggg

SEQ ID NO: 361937 - DNA, 707 bp, Homo sapiens
  misc_feature: GZ8MTXP01BXF1F.21.86.H09.1.454.CMB.2.raw
  modified_base (237)..(237): a, c, t, g, unknown or other
  modified_base (245)..(245): a, c, t, g, unknown or other
  modified_base (254)..(254): a, c, t, g, unknown or other
  modified_base (259)..(259): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagagccttgagtggctggagcattcanaggtcagntggtattcngatangctagtgtctgtgagagtcgaagtggacatcactacacgaccccagaagactctacgttcctccctgtcctagtttcgacctacttacttcgtcgaaccctcccggaacgaccacggtctgtactacttagttgtagtaacgtactacgtacccgacggacggggtcctaccgaacctaccgtacccggaccccggttacggggggggacccgaaaccggggtaaccccgttacggtaccccgtaaccccggttcccttccccgttacccgaccggtacccccgttaccccgaaacccgggtaacccggggtaaccccgttaccggtttcccgggttcccccgtttcccccggtccgggtccccggttcccccgttcggttccccgttaacccggaccgggtaaccgtccccggaaccccggttcccggaacggaacccgaaccccgg

SEQ ID NO: 361938 - DNA, 649 bp, Homo sapiens
  misc_feature: GZ8MTXP01DRCOP.21.86.H09.1.454.CMB.2.raw
  modified_base (195)..(195): a, c, t, g, unknown or other
  modified_base (302)..(302): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggagtggtgaagccctgcagaccctctcactcacctgcgacatcgtccgggganagtatctttatcaccactagtacttggaattggatcaggcagtccccgtgagaggcttgagtggctagggaagactattcacgaggtccagatggtattctgattangcagtgtctggtagagaagtcgaatggacatcactacaccgaccacgaagaatcaagttcctccctgcctaatttcgacctacttcgtagtacgacctacccgacgacgacgtctacgttacttactacttagtagtaacgactaccgttacccggaacggtacgggggtcctacccgtaaccgacccgtccggaccccggtaccggggacccggtacggtaacccgtacgtcctaacccgtccgttcccttaccgaccgtaccccgtacccgaaccccggaccggttaccccgtaacgttacccggtcccgttcccccgtcgggttccccgtcccgttccgtcccg

SEQ ID NO: 361939 - DNA, 733 bp, Homo sapiens
  misc_feature: GZ8MTXP01DZHJC.21.86.H09.1.454.CMB.2.raw
  modified_base (159)..(159): a, c, t, g, unknown or other
  modified_base (261)..(261): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccctgagaggccttgagtggctgggaagacattcacaggtccagatggtattctgatangctagtgtctgtgagaagtcgaaatcggacatcaactacacgacccaacgaagaatcagttcctcctgctattcgctactctagtcgacctacccgacgacaccgggtcttacggttaccttaacgttagtttacggtaacgtaaacggaacctaaccgttaccccgaaacgggtaaccgggggtcccttaaccccgaacccgtaccccggttacccggtaacccccgggttacggggggggaaccccgtaaaccgggggtaaacccccttacggtaccccgtaaccccggttcccgtaccccttacccgaaccggtccccgttaacccccgaaacccggtaaacccggggtccccctaaccggtttcccccgggttaaccccgtttccccccggtaggtcccccgttaccccgttcgacccgttaacccgacggaaccggtcccacccgttccggaacgttccggaacccg

SEQ ID NO: 361940 - DNA, 694 bp, Homo sapiens
  misc_feature: GZ8MTXP01BU65J.21.86.H09.1.454.CMB.2.raw
  modified_base (196)..(196): a, c, t, g, unknown or other
  modified_base (245)..(245): a, c, t, g, unknown or other
  modified_base (294)..(294): a, c, t, g, unknown or other
tcagtcgtcgctcgcacgaccggtgctcgatttagtgctatagacttgggtttggggggaagaggaagactgacggtcctgcccgtactgggcctcccatggggtatcctgtcgcaaatacagctgcagcagtccggtccaggactggtgaagccctcgcagaccctctcactcacctgcgacatcgtccgggganagtatcttatcaccactagtactggaattggatcagcagtcccgtgagngccttgagtggctgggagacatcacaggtcagatagtattctgtattangctagtgtctgtgagaagtcgaatagggactatcaactaccaaccgaacccacgaaagtaactactaacgttcctccctagcttattcgctactacgtcgtacgtactacccgacggactaccggtacttacgttacttacttagtttacgttaacgtaacggtacctaccgtacccgaacgggttacgggggacccttaccgaacccgtaccgcccgtaaccccggttaccggggaaccccgtacgggggtaaaccccttacggtaccccgaacccggttccttaccccgttaccacccggtaccccttaaccccgaacccggttacccggttccccgtaaccgttcccggttaacccgtttccccccgcgggttacccgtccccgttcggttccccgg

SEQ ID NO: 361941 - DNA, 539 bp, Homo sapiens
  misc_feature: GZ8MTXP02JTUKU.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaaatggacatcactacagacccacgaagatcagttctcctgcatttgctactctgtgacctccgacgacacggctgtctactattgtagtaagacatacccacgacggggctccgacacgtccgacccgtcggggaccgacgggaaccctacgtaccaccgtctcctcacgccctccaccgaacggcccacgtccggtccttcccccgtcggccgcccgtcgcctccgacggacgccaccgtccgacgacgccg

SEQ ID NO: 361942 - DNA, 538 bp, Homo sapiens
  misc_feature: GZ8MTXP02G7I7N.21.86.H09.1.454.CMB.2.raw
  modified_base (265)..(265): a, c, t, g, unknown or other
  modified_base (311)..(311): a, c, t, g, unknown or other
  modified_base (322)..(322): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattangcagtgtctgtgagagtcgaatggacatcactacagacccacgaanatcagtctccngctatttgctactctgtcgacctcccgacgacacggctgtctactattgtagtaagacactcccacgacggggctaccacactccgacccgtcgggaccgacgggaaccctacgtaccaccgtcctcctcacgcctccaccgaaccggcccacgtccggtcccttccccgtcggccgccctcgccgtccgacgacgccaccctccgacgacgaccg

SEQ ID NO: 361943 - DNA, 539 bp, Homo sapiens
  misc_feature: GZ8MTXP02ISOYK.21.86.H09.1.454.CMB.2.raw
  modified_base (159)..(159): a, c, t, g, unknown or other
  modified_base (311)..(311): a, c, t, g, unknown or other
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattcacaggtccagatggtattctgattatgcagtgtctgtgagaagtcgaaatggacatcactacagacccacgaanaatcagttcncctgctatttgctactctgtcgactcccgaacgacacggctgtctactattgtgtaagacatcccacgaggggctccgacactccgaccccgtcggggcccgacgggaaccctacgtccaccgtcctccctcacgccctccaccgaacggcccacgtccggtccttccccgtcggtccgccctcgcctccgacggacgccaccgtccgacgacgaccg

SEQ ID NO: 361944 - DNA, 532 bp, Homo sapiens
  misc_feature: GZ8MTXP02JM4RA.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagaatcagttcctcctgcatttgcactctgtgacctcccgacgacacggctgtctactattgtgtaagacatcccacgagggggctccacactccgaccccgtcggggccacgggaccctacgtccaccgtctcctcacgcctccaccgaacgggcccacgtccggtccttcccccgtcggccgccctcgcctccgacggacgccaccgtccgacgacgccg

SEQ ID NO: 361945 - DNA, 533 bp, Homo sapiens
  misc_feature: GZ8MTXP02F80GW.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaaatggacatcactacagacccacgaagaatcagttctcctgcatttgcactctgtcgactcccgagaccacggctgtctactattgtgtaagacatcccacgacggggctccgacactccgaccccgtggggccagggaaccctacgtcaccgtctcctcacgcctaccaccgaacgggcccacgtccggtccttccccgtcggcccgccctcgcctccgacggacgccaccgtccgacgacgaccg

SEQ ID NO: 361946 - DNA, 568 bp, Homo sapiens
  misc_feature: GZ8MTXP02GYRPK.21.86.H09.1.454.CMB.2.raw
  modified_base (313)..(313): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaaatggacatcactacagacccacgaanaatcagttctcctgctatttcgctactctgtcgacctcccggacgaccacggctgttactacttattgtagtaaacgacactacccacgacggggacctacccgacaccgtaccgaccccgtcggggacccgaacgggaaccctacggtaccacccgtcctccctcgaccgccctaccgaccgaacggcccacgtccgtcccttccccgtcggcccgccctcgcctccgacggacgccacctccgacgacgaccg

SEQ ID NO: 361947 - DNA, 550 bp, Homo sapiens
  misc_feature: GZ8MTXP02GOIXE.21.86.H09.1.454.CMB.2.raw
  modified_base (159)..(159): a, c, t, g, unknown or other
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctggggaagacattctacaggtccagatggtattctgattangcagtgtctgtgagaagtcgaatggacatcactacagacccacgaagaatcagttctcctgctatttgctactctgtcgacctcccgacgacacggctgtctactattgtagtaagacactacccacgacggggcctccgacacctccgaccccgtcgggaccgacgggaaccctacgtccaccgtctcctcacgcctccaccgaacggcccacgtccggtcccttccccgtcggtcccgcccgtcgccgtccgacggaccgaccgacccgtccgacgacgccg

SEQ ID NO: 361948 - DNA, 546 bp, Homo sapiens
  misc_feature: GZ8MTXP02GJ6B6.21.86.H09.1.454.CMB.2.raw
  modified_base (507)..(507): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagaagtcgaatggacatcaactacagacccacgaagaatcagttcctcctgctatttgctactctgtcgacctcccgagaccacgctgtcctactattgtagtaagacactacccacgacggggcctccacacctaccgaccccgtcgggacccgacgggaaccctacgtaccacccgtctccctcacgcctaccaccgaacggcccacgtccgtccctccccgtcggccnccctcgcctccgacggcgccacccgtccgacgacgaccg

SEQ ID NO: 361949 - DNA, 538 bp, Homo sapiens
  misc_feature: GZ8MTXP02IET6A.21.86.H09.1.454.CMB.2.raw
  modified_base (323)..(323): a, c, t, g, unknown or other
  modified_base (505)..(505): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagagtcgaaatggacatcactacagacccacgaagaatcagttcncctgctatttgctactctgtcgactccgacgacaccggctgtctacttatgtgtaagacactcccacgaggggcctccaccactccgaccccgtcgggaccacggggaaccctagccaccgtctcctcacgccctccaccgaacggcccacgtccggtccttccccgtcggccgcccgtccnccgtccgacgacgccgaccgaccgacgacgacg

SEQ ID NO: 361950 - DNA, 542 bp, Homo sapiens
  misc_feature: GZ8MTXP02JTVWS.21.86.H09.1.454.CMB.2.raw
  modified_base (240)..(240): a, c, t, g, unknown or other
  modified_base (358)..(358): a, c, t, g, unknown or other
  modified_base (456)..(456): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattcacnggtccagatggtattctgattatgcagtgtctgtgagagtcgaatggacatcactacacgacccaacgaagaatcagttcctcctgcctatttcgctactctgcgacctcccgagacncggctgtctactattgtagtaagacactcccgagtacgggggctaccacacgtccgaccccgtggggccgacgggaccctagtccaccgtcctcctcncgcctaccaccgaacggcccacgtccggtccttcccccgcggtccgcccgtcgcctccgacggacgcaccgtaccgacgacgaccg

SEQ ID NO: 361951 - DNA, 557 bp, Homo sapiens
  misc_feature: GZ8MTXP02JXSOF.21.86.H09.1.454.CMB.2.raw
  modified_base (357)..(357): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctcctgcatttgcactctgtgactcccgacgacacggctcgtctactattgtgtaagacntcccacagggggctcacactcgaccccgtgggccagggacctacgtcaccgtctcctcacgcctccaccaacgggcccacgtccgtccttcccccgtcggccgccccgtcgcctccacggacgcaccctccgacgacgcacgacgccggcccgtcgggcctcgcccgtcggtacaaggaccttaccgttcccggaaccgg

SEQ ID NO: 361952 - DNA, 534 bp, Homo sapiens
  misc_feature: GZ8MTXP02JHENS.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaaatggacatcactacagacccacgaagatcagttctcctgcatttgctactctgtgacctcccgagacacggctgtctactattgtgtaagacatcccacgaggggctccgacactccgaccctggggccaggacctacgtacaccgtcgtcctctacgccgtaccaccgaacggaccgaccgtcgtcccgtcccctccggtccgcccgtccgtccgtccgacgacgcgaccgtaccgacgacgaccg

SEQ ID NO: 361953 - DNA, 541 bp, Homo sapiens
  misc_feature: GZ8MTXP02JSJ53.21.86.H09.1.454.CMB.2.raw
  modified_base (159)..(159): a, c, t, g, unknown or other
  modified_base (323)..(323): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtcgagaggccttgagtggctgggaagcattctacaggtccagatggtattctgattatgcagtgtctgtgagaagtcgaaatggacatcactacagacccacgaagaatcagttcncctgctatttgcatctgtcgactcccgagacaggctgtctactattgtagtaagacatcccacgacgggggctccgacacctaccgaccccgtcggggccgacgggaccctacgtccaccgtcctcctcacgccctaccaccgaacggtcccacgtccggtccttccccgtcggcccgccctcgcctcccgacggacgccaccgtaccgacgacgccg

SEQ ID NO: 361954 - DNA, 529 bp, Homo sapiens
  misc_feature: GZ8MTXP02GBWJA.21.86.H09.1.454.CMB.2.raw
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggcccagggaaccctagtcaccgtctcctcagcctccaccaagggcccatcggtcttccccctggccgccctgcctccacggagcacctccgagacgcacacgcggccctgggctgcctggtcaaggactacttcccgacg

SEQ ID NO: 361955 - DNA, 560 bp, Homo sapiens
  misc_feature: GZ8MTXP02JJPIM.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagactcagttctcctgctatttgctactctgtcgacctccgacgacacggtctgtctactacttgtagtaagactactacccgacgacgggggcctaccaccaccgtccgaccccgtacggggcccgaacgggtaccctacgtccacccgtcctcctcacgccctaccgaccgaacggcccacgtccggtccttccccgtcggcccgcccgtcgcctaaccgacggacgccaccgtaccgacgacgaccg

SEQ ID NO: 361956 - DNA, 545 bp, Homo sapiens
  misc_feature: GZ8MTXP02J2MIF.21.86.H09.1.454.CMB.2.raw
  modified_base (355)..(355): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggcattctacaggtccagatggtattctgattatgcagtgtctgtgagaagtcgaatggacatcactacagacccaccgaagaatcagttctcctgcatttgcactctgtgactcccgacgacacggctgtctactattgtgtaagacntcccacgagggggctccacactcgaccctggggccagggaaccctagcaccgtctcctcacgcctccaccaacgggcccacgtccggtccttcccccgtggccgcccttcgcctccgacggacgccacctccgacgacgcacacgccggcccgtcgggctcgccgtcggcaacggcctaccgttccgacg

SEQ ID NO: 361957 - DNA, 576 bp, Homo sapiens
  misc_feature: GZ8MTXP02HNNJ1.21.86.H09.1.454.CMB.2.raw
  modified_base (160)..(160): a, c, t, g, unknown or other
  modified_base (171)..(171): a, c, t, g, unknown or other
  modified_base (260)..(260): a, c, t, g, unknown or other
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatctccgggganagtatctttancaccactagtacttggaattggatcaggcagtccccgtgagaggccttgagtggctgggaagacattctacaggtccagatggtattcngattangcagtgtctgtgagagtcgaatggacatcactacacgacccacgaagaatcagttcctcctgactatttcgctactcttgtcgacctcccgacgacacggctgtctactattgtagtaacgacactacccgacgacgggggcctaccgaccaccgtacccggaccccgtacggggacccgtaacgggaacccgtacgtacccgacccgtcctccctcgaccgccctacccgaccgaacggcccacgtccggttcccttccccgtcggccgcccgtcgccgtccgacggacgccaccgccgacgacgaccg

SEQ ID NO: 361958 - DNA, 545 bp, Homo sapiens
  misc_feature: GZ8MTXP02GE7LQ.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctggggaagcattctacaggtccagatggtattctgattatgcagtgtctgtgagaagtcgaatggacatcactacagacccacgaagatcagttcctcctgctatttcgctactctgtcgacctcccgacgacacggctgtctactattgtagtaagacactacccacgacggggctaccgacacgtccgacccgtcgggaccgacggaaccctacgtccaccgtcctcctcacgcctaccgaccgaacggacccacgtccgtccttccccgtcggccgcccgtcgcctccgacggacgccgaccgtccgacgacgaccg

SEQ ID NO: 361959 - DNA, 535 bp, Homo sapiens
  misc_feature: GZ8MTXP02GAXW1.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagagtcgaatggacatcactacagacccacgaagatcagttctcctgcatttgcactctgtcgacctcccggacgacacggtctgtctactattgtagtaagacactccacgacggggctccgacactcgacccgtgggccgagggaccctacgtcaccgtctcctcacgcctccaccgaacggcccacgtccggtcccttcccccgtcggcccgccctcgccgtccgacggacgccgacccgtaccgacgacgaccg

SEQ ID NO: 361960 - DNA, 566 bp, Homo sapiens
  misc_feature: GZ8MTXP02JQRWC.21.86.H09.1.454.CMB.2.raw
  modified_base (170)..(170): a, c, t, g, unknown or other
  modified_base (260)..(260): a, c, t, g, unknown or other
  modified_base (266)..(266): a, c, t, g, unknown or other
  modified_base (357)..(357): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttancaccactagtacttggaattggatcaggcagtccccgtgagaggccttgagtggctggggaagacattctacaggtccagatggtattcngattangcagtgtctgtgagaagtcgaaatggacatcactacagacccacgaagaatcagttctcctgctatttgctactctgtgacctccgagacncggctgtctactattgtagtaagacactaccacgacggggcctccgacaccgtaccgaccccgtcggggacccgacgggaaccctacgtaccaccgtcctaccctcgacgccctaccgacccgaacggcccacgtccggtcccgttcccccgtcggtcccgcccgttccgcctccgacggaccgccgacccgtacccgacgacgacccg

SEQ ID NO: 361961 - DNA, 536 bp, Homo sapiens
  misc_feature: GZ8MTXP02GS1ZI.21.86.H09.1.454.CMB.2.raw
  modified_base (159)..(159): a, c, t, g, unknown or other
  modified_base (170)..(170): a, c, t, g, unknown or other
  modified_base (258)..(258): a, c, t, g, unknown or other
  modified_base (311)..(311): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctacaggtccagatggtattcngattatgcagtgtctgtgagaagtcgaaatggacatcatacagacccacgaanatcagttctcctgcatttgctactctgtcgactcccgagacacggctgtctactattgtagtaagacactcccacgaggggctaccacacctccgaccccgtcggggaccgacgggaccctacgccaccgtcctcctcacgcctaccaccgaacggcccacgtccggtccttccccgtcggcccgcccgtcgcctccgacggacgccaccgtccgacgacgaccg

SEQ ID NO: 361962 - DNA, 528 bp, Homo sapiens
  misc_feature: GZ8MTXP02JFB9W.21.86.H09.1.454.CMB.2.raw
  modified_base (194)..(194): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattcacaggtccagatggtattctgattatgcagtgtctgtgagagtcgaatggacatcactacacgaccacgaagatcagttctcctgctatttgctactctgtcgactcccgacgacacgctgtctactacttgtagtaagacactaccacgacggggctaccacacgtccgacccgtcgggccgacggacctagccaccgtctcctcacgcctccaccgacggccaacgtccgtcctccccgtcgccgcctcgtccg

SEQ ID NO: 361963 - DNA, 553 bp, Homo sapiens
  misc_feature: GZ8MTXP02HP9K8.21.86.H09.1.454.CMB.2.raw
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagtctcctgcatttgcactctgtgactccgacgacacggctcgtctactattgtgtaagacactcccacaggggtcctccgacactccgaccctggggcccacgggaaccctagtcaccgtctcctcacgcctccaccgaacgggcccacgttccggtccttcccccgtggcccgcccctcgcctccgaggacgcacctccgagacgcacacgccgccctgggctcgccgtcggtccaacggtacctaccgttccgacgg

SEQ ID NO: 361964 - DNA, 553 bp, Homo sapiens
  misc_feature: GZ8MTXP02FLU41.21.86.H09.1.454.CMB.2.raw
  modified_base (194)..(194): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgattatgcagtgtctgtgagaagtcgaaatggacatcactacacgacccacgaagaatcaagttctccctgctatttgctactctgtgactcccgacgacacgctgtctactattgtagtaagacactaccacgtacggggctaccgacaccgtccgacccgtcggggccgacgggaacccgtacgtaccaccgtctcctcacgtccctaccaccgaacggcccaacgtccgtccgttccccgtcgccgtccctcgtccg

SEQ ID NO: 361965 - DNA, 536 bp, Homo sapiens
  misc_feature: GZ8MTXP02HYSTW.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagatcagttctcctgctatttgctactctgtcgacctcccgacgacacggctgtctactattgtagtaagacactacccacgaggggcctccacactccgacccgtcgggccgacgggaccctacgtccaccgtctcctcacgcctaccaccgacggcccacgtccggtccttccccgtcgccgtcccgtcgcctccgacggacgccaccgtccgacgacgaccg

SEQ ID NO: 361966 - DNA, 531 bp, Homo sapiens
  misc_feature: GZ8MTXP02HR9EH.21.86.H09.1.454.CMB.2.raw
  modified_base (195)..(195): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattcacaggtccagatggtattctgatttatgcagtgtctgtgagaagtcgaatggacatcactacacgacccacgagaatcagttctccctgctatttgcactctgtgactcccgacgacacgctgtctactattgtagtaagacatccacgaggggctcacacgtccgacccgtcgggccgacggaccgtacgtcaccgtcctcctcacgcctccaccacggcccaacgtccgtcctccccgtcgccgcccgtcgtccg

SEQ ID NO: 361967 - DNA, 548 bp, Homo sapiens
  misc_feature: GZ8MTXP02GR0GD.21.86.H09.1.454.CMB.2.raw
  modified_base (357)..(357): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacntccacagggggctccacactcgaccctggggccagggaaccctagtcaccgtctcctcacgcctccaccaacgggcccactcggtccttcccccgtcgccgccctcgcctccacggacgccacctccgacgacgcacacgccggcccgtcgggctcgcccgtggtccaaggacctaaccgttcccgaacgg

SEQ ID NO: 361968 - DNA, 544 bp, Homo sapiens
  misc_feature: GZ8MTXP02H31TY.21.86.H09.1.454.CMB.2.raw
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagaagtcgaatggacatcactacagacccacgaagaatcagttcncctgctatttgctactctgtcgacctccgacgacacggctgtctactatgtgtaagacactacccacgacggggctaccacacctccgacccgtcggggacccgacgggaaccctacgtccaccgtcctcctccacgccctaccaccgaacggcccacgtccggtcccttcccccgtcggcccgcccgtcgcctccgacggacgccaccgtccgacgacgccg

SEQ ID NO: 361969 - DNA, 534 bp, Homo sapiens
  misc_feature: GZ8MTXP02HU23N.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaggacattctacaggtccagatggtattctgattatgcagtgtctgtgagagtcgaatggacatcatacagacccacgaagatcagtctcctgctatttgactactctgtcgactcccgacgaccacggctgttctactatgtgtaagacatcccacgacggggctccacacctcgccccgtggggcccaacgggaaccctagtcccaccgtcctcctcacgccctaccaccaacgggcccacgtccggtcccttcccccgtcggcccgccctcgcctccgacgacgccaccgtccgacgacgcc

SEQ ID NO: 361970 - DNA, 652 bp, Homo sapiens
  misc_feature: GZ8MTXP02HEG6K.21.86.H09.1.454.CMB.2.raw
  modified_base (159)..(159): a, c, t, g, unknown or other
  modified_base (170)..(170): a, c, t, g, unknown or other
  modified_base (256)..(256): a, c, t, g, unknown or other
  modified_base (264)..(264): a, c, t, g, unknown or other
  modified_base (266)..(266): a, c, t, g, unknown or other
  modified_base (272)..(272): a, c, t, g, unknown or other
  modified_base (275)..(275): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacatcacaggtccagatggattcngatttagngnagtgtntgngagagtgagtgacatcactacacgacccaacgaagactctacgttcctcctagactagttcgactactcgtgtcgacccgtaccgaacgaccgacggtctacgttactacttagttagtagtaacactaccgtacccgacggacgggtacctaccgaccgtaccgtacccggtaccccggtaccgggacccgtaaccggtaacccgtaaccgtacccgtacccgtacccgttaccctacccgtaccgacccgtacccgacccgaacccggacccgtacccgttcccggttccccgttcccccgttcccggtacccgtcccgtcccgtcccgtaacccgtaccggaccgtacccgacccgtacccggaccgacgaccg

SEQ ID NO: 361971 - DNA, 791 bp, Homo sapiens
  misc_feature: GZ8MTXP02IY0TX.21.86.H09.1.454.CMB.2.raw
  modified_base (127)..(127): a, c, t, g, unknown or other
  modified_base (153)..(153): a, c, t, g, unknown or other
  modified_base (164)..(164): a, c, t, g, unknown or other
  modified_base (231)..(231): a, c, t, g, unknown or other
  modified_base (239)..(239): a, c, t, g, unknown or other
  modified_base (248)..(248): a, c, t, g, unknown or other
  modified_base (254)..(254): a, c, t, g, unknown or other
  modified_base (260)..(260): a, c, t, g, unknown or other
  modified_base (308)..(308): a, c, t, g, unknown or other
tcagtcgtcgctcgcacgaccggtgctcgatttagtgctatagacttggtttggagatcatgaggtgtcctgtcgcaatacagctgcagcagtccggtccaggactggtgaagccctgcagaccctntcactcacctgcgacatctccggganagtatctttancaccactagtacttggaattggatcaggcagtccccgtgagagccttgagtggctggaagcattcanggtccagntggtattcngattangcagtntctggtgaagagtcgaatggacatccgactacgacgaccccacggaanaactctaggttacctcccgtaggactagtttcgacctaactccgttaggtcgaaccttcccccgggaaagtacaccggggtcttaggttaccctacgttagttacgtagtaaacgtacctaagtaccccgtaacgtacgggggtacccttaccgaaccgtaaccgttacccgggtaacccccgtttaccgggggaccccgtaaacgggggtaaacccccgttaacggttaaccccgtaacccgggttaccctttaccccgtaccgtaaacccggttacccccgttacccgaaaccccggtaaaacccggggtaacccccgtaaacggtttacccccgggtttccccgttttaaccccccccggttacgggtaccccggtaccccccgtttacggggtacccctttaacccccggtaaacggggaacccgttaacccccggaacccccgtttacccgggtaaccggtaacccgtaacccccggg

SEQ ID NO: 361972 - DNA, 557 bp, Homo sapiens
  misc_feature: GZ8MTXP02GYDIE.21.86.H09.1.454.CMB.2.raw
  modified_base (191)..(191): a, c, t, g, unknown or other
  modified_base (202)..(202): a, c, t, g, unknown or other
  modified_base (273)..(273): a, c, t, g, unknown or other
  modified_base (290)..(290): a, c, t, g, unknown or other
  modified_base (353)..(353): a, c, t, g, unknown or other
tcagtcgtcgctcgcacgaccggtgctcgatttagtgctatagacttgggtttggggaagaggaagactgacggtcctgcccgtactgggcctccatgggtgtcctgtcgcaaatacagctgcagcagtccggtccaggactggtgaagccctcgcagaccctctcactcacctgcgacatctccgggganagtatctttanccaccactagtacttggaattggatcaggcagtccccgtgagaggccttgagtggctgggaagcattctanggtccagatggtattcngattatgcagtgtctgtgagaagtcgaaatggacatcactacagacccacgaagatcagttcncctgcatttgctactctgtcgtactcccgacgacgacgcgtgtctactagttgtagtaagacactaccacgacggggcctaccgacaccgtaccgacccgtcgggaccgacggaccgtacgtccgtaccgtccgtccctcgacgaccctaccaccgaaccgccgaacgtccgtcccgttccccgtcggccgtcccgtcgtcccg

SEQ ID NO: 361973 - DNA, 552 bp, Homo sapiens
  misc_feature: GZ8MTXP02GLVAH.21.86.H09.1.454.CMB.2.raw
  modified_base (260)..(260): a, c, t, g, unknown or other
  modified_base (275)..(275): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctggggaagacattctacaggtccagatggtattcngattatgcagtgtcngtgagaagtcgaatggacatcactacagacccacgaagatcagttctcctgcatttgcactctgtcgactcccgagacgacgctgtctactattgtgtaagacatcccacgacggggctccgacacctaccgaccccgtcgggccgaacgggaaccctacgtccacccgtctccgtcacgtcctaccacccgaacgggcccacgtccggttcccttcccccgtcggtcccgtcccgtcgccgtcccgacggacgcccaccgtcccgacgacgacccg

SEQ ID NO: 361974 - DNA, 618 bp, Homo sapiens
  misc_feature: GZ8MTXP02G8EQX.21.86.H09.1.454.CMB.2.raw
  modified_base (159)..(159): a, c, t, g, unknown or other
  modified_base (170)..(170): a, c, t, g, unknown or other
  modified_base (240)..(240): a, c, t, g, unknown or other
  modified_base (263)..(263): a, c, t, g, unknown or other
  modified_base (269)..(269): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctanaggtccagatggtatctgattangcagtntctgtgagaagtcgaaatggacatcaactacacgaacccaacgaagaactcagttcctccctgcctatttcgactacttctgtcgacctcccgaagacacggtctgtactactattgtagtaagacactcccaacgacggggcctaccaccactacccgaccccgtacggggacccgtaacgggaacccgtacgtaccgtacccgtacctccctaccgacgtacccctacccgaacccgaaccgggtacccctacgttcccggtacccgttcccccggtcggtccccgtccccgttccgcccgttaacccgacggaccgacccgtacccgtacccggaacgacgacccg

SEQ ID NO: 361975 - DNA, 536 bp, Homo sapiens
  misc_feature: GZ8MTXP02GGSY0.21.86.H09.1.454.CMB.2.raw
  modified_base (133)..(133): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgattatgcagtgtctgtgagaagtcgaatggacatcactacagacccaccgaagaatcagttctcctgcatttgcactctgtgactcccgacgacgcggctcgtctactattgtagtaagacatcccacgacgggggctccacactccgaccccgtggggcccacgggaaccctagtccaccgtcctcctcacgcctccaccacggccatccgtctcccctgccgcctcgctccgagcgcacctcgacgacgcacgcgccgcccgtcggctcgccgtcggtcaacggacctaccgttccgacgg

SEQ ID NO: 361976 - DNA, 536 bp, Homo sapiens
  misc_feature: GZ8MTXP02JX9DJ.21.86.H09.1.454.CMB.2.raw
  modified_base (504)..(504): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaaatggacatcactacagacccacgaagaatcagttctccctgcatttgcactctgtgactcccgacgacacggctgtctactattgtgtaagcatcccacagggggctccacactcgacccctggggcccagggaaccctagcaccgtctcctcacgcctccaccaacggcccatccggtctccccgtgccgccctcgctccaggacgccacctccgagacgcacgacgccgccctgggccncgccgtcggtcaacggaccttaccgtccgacg

SEQ ID NO: 361977 - DNA, 538 bp, Homo sapiens
  misc_feature: GZ8MTXP02FQA3W.21.86.H09.1.454.CMB.2.raw
  modified_base (259)..(259): a, c, t, g, unknown or other
  modified_base (312)..(312): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcacgtcccgtcgagaggccttgagtggctgggaagacattcacaggtccagatggtattcngattatgcagtgtctgtgagaagtcgaatggacatcactacagacccacgaanatcagttctcctgctatttgcactctgtcgactcccgagacacgctgtctactattgtgtaagacatcccaacgacggggctccacacctccgaccccgtcggggaccgacgggaaccctacgtccaccgtctcctcacgcctaccgaccgacgggcccacgtccggtccttccccgcggcccgtccctcgcctccgacggacgacccaccgtaccgacgacgccg

SEQ ID NO: 361978 - DNA, 539 bp, Homo sapiens
  misc_feature: GZ8MTXP02IE6QH.21.86.H09.1.454.CMB.2.raw
  modified_base (260)..(260): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaaggcattctacaggtccagatggtattcngattatgcagtgtctgtgagaagtcgaaatggacatcactacagacccacgaagatcagtctcctgctatttgcacttctgtcgactccgacgacacgctgtctactatgtgtaagacatccacgacggggctccacactaccgaccccgtcggggccgtacgggaaccctacgtccaccgtctcctcacgcctccaccgtaacggcccacgtccggtccttcccccgcggtcccgcccgtcgcctcccgacggacgccacccgtccgacgacgacccg

SEQ ID NO: 361979 - DNA, 549 bp, Homo sapiens
  misc_feature: GZ8MTXP02HTPE5.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaaggcattctacaggtccagatggtatctgattatgcagtgtctgtgagaagtcgaaatggacatcactacagacccacgaagaatcagttctccctgctatttcgctactctgtcgacctcccgagaccacgctgtctactattgtagtaagactactcccgacgacggggcctccgacaccgtccgaccccgtcgggccgacgggaccctacgtccaccgtcctcctcacgccctaccaccgaacggcccacgtccggtccctccccgttcggcccgcccgtcgcctccgacggtacgccgacctccgacgacgaccg

SEQ ID NO: 361980 - DNA, 535 bp, Homo sapiens
  misc_feature: GZ8MTXP02FJLLN.21.86.H09.1.454.CMB.2.raw
  modified_base (343)..(343): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattatgcagtgtctgtgagaagtcgaatggacatcactacagacccacgaagaatcagttctcctgctatttgcactctgtnacctcccgagacacggctgtctactattgtgtaagacatcccacgacgggggctccacactccgaccccgtggggcccgacgggaccctacgcacccgtctcctcacgcctccgaccaacggcccacgtccggtcccttcccccgtcggcccgccctcgcctccgacggacgccacccgtccgacgacgccg

SEQ ID NO: 361981 - DNA, 761 bp, Homo sapiens
  misc_feature: GZ8MTXP02ITQ0I.21.86.H09.1.454.CMB.2.raw
  modified_base (265)..(265): a, c, t, g, unknown or other
  modified_base (313)..(313): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggctgggaagcattctacaggtccagatggtattctgattangcagtgtctgtgagaagtcgaatggacatcactacacgacccacgaanaactctagttcctcctgacctatttcgactacttcgtgtcgtaacctccccggaacgaccgaccgggtctacgttacctaacttagttagtacgtaacgaacctaccgttaccccgaaccggtaacgggggtaccctacccgtaacccgtacccgtaccccggtaccccccggttaccgggggaaccccggtaaccggggtaaacccccgttacgggttaccccgtaacccccgttcccgttacccccttaccgacccgtacccccgttaacccccgaaaccccggaaacccggggtacccccgtaaccggtttccccgggtttacccccgtttacccccccggttccgggtccccccgtcccccgttcccggtaccccgttaaccccggaaccggggtaccgtacccccgaaccccgttccccggaaaccggacccggaacccccgg

SEQ ID NO: 361982 - DNA, 560 bp, Homo sapiens
  misc_feature: GZ8MTXP02JSDB8.21.86.H09.1.454.CMB.2.raw
  modified_base (265)..(265): a, c, t, g, unknown or other
  modified_base (404)..(404): a, c, t, g, unknown or other
  modified_base (466)..(466): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaaggcattcacaggtccagatggtattctgattagngcagtgtctggtgagaagtcgaatggacatcactacacgacccacgaagatcagttctcctgctatttgctactctagtcgacctcccggacgacgacggctgtctactattgtagtaagacactcccacgcggggtcnccgacaccgtccgacccgtcggggacccgacgggaaccctacgtaccgtaccgtcctcctcncgccctacccgaccgaacgggccctacgtccggtaccctccccgtcggcccgcccgtcgcctccgacggacgccgaccgtaccgacgacgaccg

SEQ ID NO: 361983 - DNA, 533 bp, Homo sapiens
  misc_feature: GZ8MTXP02FSGI2.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtatctgattatgcagtgtctgtgagaagtcgaatggacatcactacagacccacgaagatcagttctccctgctatttgctactctgtcgactcccgacgaccacggctgtctactattgtgtaagacatcccacgacgggggctccgacactccgaccccgtcggggccacgggaccctacgtccaccgtctcctcacgcctccaccgaacggcccacgtcgtcccttccccgtcggccgccctcgcctcgacggacgccacctccgacgacgaccg

SEQ ID NO: 361984 - DNA, 606 bp, Homo sapiens
  misc_feature: GZ8MTXP02H3YU0.21.86.H09.1.454.CMB.2.raw
  modified_base (159)..(159): a, c, t, g, unknown or other
  modified_base (170)..(170): a, c, t, g, unknown or other
  modified_base (265)..(265): a, c, t, g, unknown or other
  modified_base (312)..(312): a, c, t, g, unknown or other
  modified_base (341)..(341): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacattctacaggtccagatggtattctgattangcagtgtctgtgagagtcgaatggacatcactacacgacccacgaanatcagttcctacctgctatttcgctactntgtcgacctcccgacgtacgaccgtctgttactactatgtagtaacgacactacccgacgacggggcctaccgacacctccgacccgtcggggacccgtacgggaacccctaggtacccaaccgttcctacccgttcgaaccgtccccgaccgacccgaaaccgggtcccctaacgttcccggtcccgttcccccgtcggtccccgtcccgttccgcccgttcccgaacggaccgacccgtacccgtcccggaacgaccgacccg

SEQ ID NO: 361985 - DNA, 585 bp, Homo sapiens
  misc_feature: GZ8MTXP02H8ICI.21.86.H09.1.454.CMB.2.raw
  modified_base (165)..(165): a, c, t, g, unknown or other
  modified_base (193)..(193): a, c, t, g, unknown or other
  modified_base (204)..(204): a, c, t, g, unknown or other
  modified_base (326)..(326): a, c, t, g, unknown or other
  modified_base (347)..(347): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtcaggactggtgaagccctgcagaccctntcactcacctgcgacatcgtccgggganagtatctttancaccactagtacttggaattggatcaggcagtcccgtgagaggccttgagtggctgggaaggcattcacaggtccagatggtattctgattatgcagtgtctgtgagaagtcgaaatggacntacactacacgacccacgaanatcagttcctccctgcatttgctacgtctgtcgactcccgacgacgacggctgtactactacttgtgtaagactactaccgacgtacgggggctaccgaccaccgtccgaccccgtcggggaccgtaacggaacccgtacgtaccgtacccggtcctccctaccgacgtcccgtacccgaccgaaccggacccctaacgtcccgtcccgttccccgtccggtcccgcccgttcgcccg

SEQ ID NO: 361986 - DNA, 550 bp, Homo sapiens
  misc_feature: GZ8MTXP02F76GJ.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagagtcgaatggacatcactacagacccacgaagatcagttctcctgctatttgctactctgtcgacctcccgacgacacggctgtctactattgtagtaagacactacccgacgacgggggcctccgacaccgtccgaccccgtcggggacccgacgggaccctacgtccacccgtcctcctcacgccctccaccgaacggccctacgtccggtcccttccccgtcggcccgccctcgccgtccgacggacgccaccgtccgacgacgaccg

SEQ ID NO: 361987 - DNA, 587 bp, Homo sapiens
  misc_feature: GZ8MTXP02JHNF9.21.86.H09.1.454.CMB.2.raw
  modified_base (159)..(159): a, c, t, g, unknown or other
  modified_base (266)..(266): a, c, t, g, unknown or other
  modified_base (314)..(314): a, c, t, g, unknown or other
  modified_base (335)..(335): a, c, t, g, unknown or other
  modified_base (360)..(360): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctggggaagacattctacaggtccagatggtattctgattangcagtgtctgtgagaagtcgaatggacatcactacacgacccacgaanatcagttctcctgctatttcnctacttctgtcgacctccgacgacncggcttcgtctactattgtagtaacgacactacccacggacggggtcctaccgacaccgtaccgaccccgtcggggacccgaaccgggaacccgtacgtaccaccgtcctacctccacgccctacccaccgaaccggaccctacgttcccggttcccgttcccccgtccggtcccgtcccgtccgcccgtccgacggaccgtacccgacccgtaccgacgacgaccg

SEQ ID NO: 361988 - DNA, 570 bp, Homo sapiens
  misc_feature: GZ8MTXP02HLITF.21.86.H09.1.454.CMB.2.raw
  modified_base (159)..(159): a, c, t, g, unknown or other
  modified_base (170)..(170): a, c, t, g, unknown or other
  modified_base (257)..(257): a, c, t, g, unknown or other
  modified_base (263)..(263): a, c, t, g, unknown or other
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattcacaggtccagatggtattcngattangcagtgtctgtgagaagtcgaaatggacatcactacagacccacgaagaatcagttcncctgctatttcgctactcctgtcgacctcccgacgaccacgggtctgttacctactattgtagtaagactactacccacgacggggactcccaccacgtaccgaccccgtcggggacccgtacggaacccgtacgtacctacccgtctcctccgacgccctaccaccgaacgggaccctacgtccggtccttccccgtcggcccgccctcgcctaaccgacgacgaccgacccgtaccgacgacgaccg

SEQ ID NO: 361989 - DNA, 542 bp, Homo sapiens
  misc_feature: GZ8MTXP02H11V5.21.86.H09.1.454.CMB.2.raw
  modified_base (402)..(402): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagatcagtctcctgctatttgctactctgtcgacctcccgacgacacggctgtctactatgtgtaagacatcccacgacggggctccacacnccgaccccgtcggggccgacgggaaccctacgtaccacccgtcctcctcacgccctaccaccgaacgggcccacgtccggtccttcccccgtcggcccgccctcgcctccgacggacgccgacccgtccgacgacgaccg

SEQ ID NO: 361990 - DNA, 598 bp, Homo sapiens
  misc_feature: GZ8MTXP02FY621.21.86.H09.1.454.CMB.2.raw
  modified_base (262)..(262): a, c, t, g, unknown or other
  modified_base (563)..(563): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagaggccttgagtggcgtgggaagacattctacaggtccagatggtattcngattatgctagtgtctgtgaagaagtcgaagtggacatcaactacacgaaccccaacgaagactcagttcctcctgctattcgctactctgtcacctcccgagaccgacgtctgtctactattgtagtaagactactacccgacggtacggggacctaccgacctaccgtacccgaccccggtacggggtacccgacgggtaacccgtacggtaccctacccgtcctacccgtccgaccgccctaccgaccgaaccggccctacgtccgtcccgtaccccgtcggtcccgtcccgtcgccnccgacggacgtacccgaccgtaccgacgacgaccg

SEQ ID NO: 361991 - DNA, 544 bp, Homo sapiens
  misc_feature: GZ8MTXP02JGJDV.21.86.H09.1.454.CMB.2.raw
  modified_base (357)..(357): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaatttgatcaggcagtccccgtgagaggccttgagtggctgggaagacattctacaggtccagatggtattctgattatgcagtgtctgtgagaagtcgaatggacatcactacagacccacgaagaatcagttcctcctgctatttgctactctgtcgactcccgagacncggctgtctactattgtagtaagacactcccacgacggggctccacacgtccgacccgtcggggacccgacgggaccctacgtaccaccgtctcctcacgcctaccgaccgaacggcccacgtccggtcccttccccgtcggcccgcccgtcgcctccgacggacgccgaccgtaccgacgacgccg

SEQ ID NO: 361992 - DNA, 548 bp, Homo sapiens
  misc_feature: GZ8MTXP02FW2K9.21.86.H09.1.454.CMB.2.raw
  modified_base (357)..(357): a, c, t, g, unknown or other
  modified_base (418)..(418): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggcattctacaggtccagatggtattctgattatgcagtgtctgtgagaagtcgaatggacatcactacagacccaccgaagaatcagttctcctgcatttgcactctgtgactcccgacgacacggctcgtctactattcgtgtaagacntcccacagggggctccacactcgaccctggggcccagggaaccctagtcaccgtctcctcncgcctccaccaacgggcccatccggtcttcccccgtggcccgcccctcgcctccgacggacgcaacctccgagacgcacgacgccgcccgtgggcctcgccgtcggtcgaacggactacgttcccgacgg

SEQ ID NO: 361993 - DNA, 562 bp, Homo sapiens
  misc_feature: GZ8MTXP02F072C.21.86.H09.1.454.CMB.2.raw
  modified_base (195)..(195): a, c, t, g, unknown or other
  modified_base (206)..(206): a, c, t, g, unknown or other
  modified_base (248)..(248): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagnggccttgagtggctgggaagacattctacaggtccagatggtattctgatttatgcagtgtctgtgagaagtcgaatggacatcactacacgacccacgaagaatcagttctccctgcctatttcgctactctgtcgacctcccgacgacacggtctcgtctactattgtagtaagacactcccacgaggggcctaccgaccaccgtccgacccgtcgggaccgacggaacccgtacgtctaccgtctccgtcacgccctacccaccgaaccggcccaacgtccgtccttcccccgtccggcccgcctcgtccg

SEQ ID NO: 361994 - DNA, 555 bp, Homo sapiens
  misc_feature: GZ8MTXP02GRSVV.21.86.H09.1.454.CMB.2.raw
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattangcagtgtctgtgagagtcgaatggacatcactacacgacccacgaagaatcagttcctccctgcctatttgactacttctgtcgacctcccgacgaccacggtctgtctacttattgtagtaacgacactacccacgacggggcctaccaccaccgtcccgaccccgtcggggacccgacgggaccctacgtccgacccgtctcctcacgccctaccgaccgacggccacgtccgtcctccccgtcgccgccctcgccgtccgacggacgccaccgtaccgacgacgaccg

SEQ ID NO: 361995 - DNA, 572 bp, Homo sapiens
  misc_feature: GZ8MTXP02I54IT.21.86.H09.1.454.CMB.2.raw
  modified_base (159)..(159): a, c, t, g, unknown or other
  modified_base (170)..(170): a, c, t, g, unknown or other
  modified_base (320)..(320): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctacaggtccagatggtattctgattatgcagtgtctgtgagaagtcgaatggacatcactacagacccacgaagatcagttcnccctgctatttcgctactctgtcgacctcccgagacacgggctgtctactattgtagtaagacactcccacgacggggcctccactacgtaccgaccccgtggggacccacgggaaccctacggtaccaccgtcctacctccacgccctacccgaaccgaacgggcccctacgtcccggtacccttcccccgtcggccccgtccccgtcggccctaacccgacggaccgccacccgtccggacgacgacccg

SEQ ID NO: 361996 - DNA, 533 bp, Homo sapiens
  misc_feature: GZ8MTXP02IJ49A.21.86.H09.1.454.CMB.2.raw
  modified_base (322)..(322): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagaagtcgaaatggacatcactacagacccacgaagaatcagttcncctgcatttgctactctgtgactcccgagaccacggctgtctactatgtgtaagacactccacgaggggctccgacactcgaccccgtcgggccgacgggaaccctacgtaccgaccgtcctacctcacgcctccaccgaacgggcccacgtccgtccttccccgcggccgcccgtcgcctccgacggacgccaccgtccgacgacgaccg

SEQ ID NO: 361997 - DNA, 540 bp, Homo sapiens
  misc_feature: GZ8MTXP02FQ8TN.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaagacattctacaggtccagatggtattctgattatgcagtgtctgtgagaagtcgaaatggacatcactacagacccacgaagaatcagttctcctgcatttgcactctgtgactccgacgacacggctgtctactattgtgtaagacatcccacgagggggctccgacactcgaccccgtcgggaccgacgggaaccctacgtccacccgtcctacctcacgccctaccaccgaacgggcccacgtccggtcccttccccgcggcccgccctcgcctccgacggacgaccaccgtccgacgacgaccg

SEQ ID NO: 361998 - DNA, 597 bp, Homo sapiens
  misc_feature: GZ8MTXP02H14QY.21.86.H09.1.454.CMB.2.raw
  modified_base (171)..(171): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcaggcagtccccgtgagaggccttgagtggctgggagacattcacaggtcagatggtattctgattatgcagtgtctgtgagaagtcgaaatggacatcactaacacgaccccacgaagaactcaagttcctccctagctatttgctactcgtgtcgacctcccgacgacacggctgtactactatgtagtaagacactacccacggacggggctacccgacaccgtacccgaccccggtacggggacccgaacgggtaacccctacgtaccgaacccgtcctcctaccgacgccctaccgaaccgaaccggacccgtacgtcccggtcccttcccccgtcggcccgtccccgttccgccgtaacccgacggaccgacccgacccgtaccgacgacgacccg

SEQ ID NO: 361999 - DNA, 570 bp, Homo sapiens
  misc_feature: GZ8MTXP02IOP1X.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagagtcgaatggacatcactacagacccacgaagactcagttcctcctgctatttgctactctgtcgacctccgacgacgacggctgtctactagttgtagtaagacactacccacgacggggctaccgacaccgtaccgaccccgtaggggcccgacggaacccgtacgtacccgacccgtccgtcctccacgcccgtacccaccgaaccgggtcccacgtccgtcccgttccccgtcggcccgtcccgtcgcctccgacggacggccaccgtccggaacgacggacccg

SEQ ID NO: 362000 - DNA, 535 bp, Homo sapiens
  misc_feature: GZ8MTXP02H12GB.21.86.H09.1.454.CMB.2.raw
  modified_base (356)..(356): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatcttttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagtctcctgcatttgcactctgtgactcccgacgacacggctgtctactattgtgtaagacntcccacacgggggctccacactcgacccctggggccagggaaccctagtcaccgtctcctcagcctccaccaacgggcccatcggtccttccccctgccgccctcgcctccacggacgcacctccgagacgcacacgcggccctgggctcgcctcggtcaacggactacttcccgacgg

SEQ ID NO: 362001 - DNA, 558 bp, Homo sapiens
  misc_feature: GZ8MTXP02GDGVL.21.86.H09.1.454.CMB.2.raw
  modified_base (159)..(159): a, c, t, g, unknown or other
  modified_base (240)..(240): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctanaggtccagatggtattctgattatgcagtgtctgtgagaagtcgaatggacatcaactacacgacccacgaagaatcagttcctcctgctatttgcctactctgtcgacctcccgagaccacggctgtctactattgtagtaagacactcccgacgacgggggtcctaccgacctaccgtaccggaccccgtcgggggacccgacgggtaaccctacgtaccaccgtcctcctcacgcctccgaccaacggccctacgtccgtccttccccgcgcccgcccgtcgccgtccgacgcgaccaccgtccgacgacgaccg

SEQ ID NO: 362002 - DNA, 569 bp, Homo sapiens
  misc_feature: GZ8MTXP02IXI8V.21.86.H09.1.454.CMB.2.raw
  modified_base (133)..(133): a, c, t, g, unknown or other
  modified_base (239)..(239): a, c, t, g, unknown or other
  modified_base (363)..(363): a, c, t, g, unknown or other
  modified_base (473)..(473): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttatcaccactagtacttggaattggatcaggcagtccccgtgagaggccttgagtggctgggaaggcattctacaggtccagatggtattctgattangcagtgtctgtgagagtcgaatggacatcactacagacccaccgaagaatcagttctccctgctatttcgctactctgtgacctcccgacgacacggtctcgtctacttattcgtagtaagacnctcccagacggggtcctccgacactccgacccgtcgggcccgacgggaccctacgtcacccgtctcctcacgcctccaaccgacggcccacgttcggtcccttcccccgngcccgcccgtcgccgtccgacgtaccgccaccgtaccgacgacgcacgacgcgcccgtcggctcggtctcggtacacggacctacgtacccgacgg

SEQ ID NO: 362003 - DNA, 545 bp, Homo sapiens
  misc_feature: GZ8MTXP02JTDXQ.21.86.H09.1.454.CMB.2.raw
  modified_base (194)..(194): a, c, t, g, unknown or other
  modified_base (204)..(204): a, c, t, g, unknown or other
  modified_base (298)..(298): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatcttancaccactagtacttggaattggatcaggcagtccccgtgagaggccttgagtggctgggaagcattctacaggtccagatggtattctgattangcagtgtctgtgagaagtcgaatggacatcactacacgacccacgaagaatcagttctcctgctatttgctactctgtcgactcccgacgacacgctgtctactattgtagtaagacactaccacgacggggctccgacaccgtccgacccgtcggggccgacgggaccctacgtccaccgtcctcctcacgcctccaccgaacggcccaacgtccggtccttccccgtcggccgcccgtcgtcccg

SEQ ID NO: 362004 - DNA, 544 bp, Homo sapiens
  misc_feature: GZ8MTXP02I112R.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagaccccacgaagaactcagttctcctgcctatttgctactctgtcgacctcccgacgacacggcttgtctactattgtagtaagacactaccacgacggggctccacactccgacccgtcggggaccgacggaccctacgtccaccgtctcctcacgcctaccaccgacggcccacgtccgtccttccccgtcggccgcccgtcgccgtccgacggacgaccgacccgtaccgacgacgaccg

SEQ ID NO: 362005 - DNA, 541 bp, Homo sapiens
  misc_feature: GZ8MTXP02IEXST.21.86.H09.1.454.CMB.2.raw
  modified_base (357)..(357): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctggggaaggacattctacaggtccagatggtattctgattatgcagtgtctgtgagaagtcgaatggacatcactacagacccaccgaagaatcagttctcctgctatttgcactctgtgactcccgacgacgcggctcgtctactatgtgtaagacnctcccacacgggggctccacactccgaccccgtgggccgacgggaacctacgtccaccgtcctctcacgcctccaccacgggcccacgtcgtccttcccgtcgccgcctcgctccgagcgcacctccgagacgcacgacgccgccgtcggctcgcctcggtcaacggtacctacttccgggacg

SEQ ID NO: 362006 - DNA, 573 bp, Homo sapiens
  misc_feature: GZ8MTXP02HR36U.21.86.H09.1.454.CMB.2.raw
  modified_base (320)..(320): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagagtcgaaatggacatcactacagacccacgaagatcagttcncctgctatttcgctactctgtcgacctcccgagaccacggtctgtctactattgtagtaaagacactacccgacgacggggtctaccacaccgtccgaccccgttcggggacccgtacgggaaccctacgtaccgaacccgtcctccgtccacgccctacccgaaccgaacggccctacgttcccggtcccttcccccgtcggccgcccgtcgcctaaccgacggacgccgacctacccggacgacggacccg

SEQ ID NO: 362007 - DNA, 545 bp, Homo sapiens
  misc_feature: GZ8MTXP02F9KZ8.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagagtcgaatggacatcactacagacccacgaagaatcagttcctcctgctatttgctactctgtcgacctcccgacgacacggctgtctactattgtagtaagacactccacgacggggctccacactaccgacccgtcgggaccgacggaaccctacgtaccaccgtcctcctcacgccctaccaccgaacggccctacgtccggtcccgttccccgtcgcccgcccgtcgccgtccgacggacgaccaccgtaccgacgacgaccg

SEQ ID NO: 362008 - DNA, 688 bp, Homo sapiens
  misc_feature: GZ8MTXP02GN0WV.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattcacaggtccagatggtattctgattatgcagtgtctgtgagagtcgaatggacatcactacagacccacgaagatcagttctcctgctatttcgactactctgtcgacctcccggacgacacgggtcttgtactactattgtagtaagactactacccgacggacgggggtcctaccgaccacgttacccggaccccgttacgggggacccgtaacgggggaacccccgttacggttaccccgtaaccccggttcccttccccgttacccgaccggtaccccttaccccgaaaccccgtaaaaccgggggccccctaaccggttcccgggggtttaccccctttaccccccggtccgggtcccccgtacccccggttccggtccccgttaaccccggaccgggaaccggtccccgaaccccgttacccgggaaccggtaaccggaccccgg

SEQ ID NO: 362009 - DNA, 593 bp, Homo sapiens
  misc_feature: GZ8MTXP02HXL5K.21.86.H09.1.454.CMB.2.raw
  modified_base (160)..(160): a, c, t, g, unknown or other
  modified_base (171)..(171): a, c, t, g, unknown or other
  modified_base (259)..(259): a, c, t, g, unknown or other
  modified_base (265)..(265): a, c, t, g, unknown or other
  modified_base (312)..(312): a, c, t, g, unknown or other
  modified_base (325)..(325): a, c, t, g, unknown or other
  modified_base (340)..(340): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcaggcagtccccgtgagaggccttgagtggctgggaagcattctacaggtccagatggtattcngattangcagtgtctgtgagaagtcgaatggacatcactacagacccacgaanatcagttcctccngctatttgctactcngtcacctcccgacgaccacggtctgttcctacttattcgtagtaacgacactacccgacggacggggcctaccgacaccgtacccgaccccgtcggggaccgaccgggtaacccgtacggtacccgacccgttcctacccgtacgaccgaccctacccgaaacccgaaccgggacccctacgttcccggtcccttcccccgtcggtcccgccccgtcgccctccgacggacgtccgacccgccgacgacgccg

SEQ ID NO: 362010 - DNA, 681 bp, Homo sapiens
  misc_feature: GZ8MTXP02IMCDV.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcctccggggagagtatctttatcaccactagtacttggaattggatcaggcagtccccgtgagaggccttgagtggctgggaagcattctacaggtccagatggtattctgattatgcagtgtctgtgaagagtcgaatggacatcactacacgaaccccacgaaagaactcacgttcctccctgcctatttcgctacttcgtgtcgtacctcccggacgaccacgggtctgttactacttattgtagtaacgacacgtacccgacggacgggggtcctaccgaccaccgtacccggtacccccgtacgggggaccccgtaaccggggtaaccccttacggtacccgtaacccgttccctcccgttaccgaccggtccccttaccccgaaaccccggaaacccggggtaccccgtaaccgttcccgggttccccgtttaccccccggtcgggtccccggtcccccgtccggtcccgttaacccggaacgggaaccggcccgtaacccgtacccggaacggaccggaacccgg

SEQ ID NO: 362011 - DNA, 587 bp, Homo sapiens
  misc_feature: GZ8MTXP02IMJN2.21.86.H09.1.454.CMB.2.raw
  modified_base (195)..(195): a, c, t, g, unknown or other
  modified_base (297)..(297): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggcttgagtggctgggaagcattcacaggtccagatggtatctgattangcagtgtctgtgagaagtcgaatggacatcaactacacgaccccacgaagaatcacgttcctccctgctatttgacctacttcttgtcgacctcccgacgacgacggcttcgtacttacttagttgtagtaacgacactcccgacgtacggggcctaccacaccgtaccgaccccggtcgggaccgaccggacccgtacgtccctaccgtcctccctacaccgtccctacccgaccgaaccggccctaacgttcccggtcccttcccccgcggtcccgtcccgtcgcccg

SEQ ID NO: 362012 - DNA, 545 bp, Homo sapiens
  misc_feature: GZ8MTXP02IWOND.21.86.H09.1.454.CMB.2.raw
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattangcagtgtctgtgagagtcgaatggacatcactacagacccacgaagactcagttctccctgctatttgctactctgtcgacctcccgacgacacggctgtctactattgtgtaagacactcccacgaggggctccacactccgaccccgtcgggaccgacggacccgtacgtccaccgtcctcctcacgtccctaccgaccgaaccgggacccacgtccggtcccttcccccgtcggcccgcccgtcgcctccgacggacgccacctccgacgacgaccg

SEQ ID NO: 362013 - DNA, 652 bp, Homo sapiens
  misc_feature: GZ8MTXP02GCXYZ.21.86.H09.1.454.CMB.2.raw
  modified_base (240)..(240): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcanaggtccagatggtattctgattatgcagtgtctgtgagaagtcgaatggacatcactacacgacccacgaagatcagttcctcctgctatttcgctacttctgtcgaccctcccgaacgaccgaccgggtctacgtaccttacttagtttaggtagtaaacgtactacgtacccgaaccggtacgggggacctacccgacctaccgtaccccggacccccggtaccgggggaccccgaaccggggtaaaccccgtacggttacccgaacccggttccctacccgtaccgtaccgacccctacccgaacccgaaccgggtacccctacgttcccggttccccttcccccggtcggtccccgtccccgtccgcccgtaacccgacggaccgtccacccgtccggacgacgaccg

SEQ ID NO: 362014 - DNA, 549 bp, Homo sapiens
  misc_feature: GZ8MTXP02JULZM.21.86.H09.1.454.CMB.2.raw
  modified_base (159)..(159): a, c, t, g, unknown or other
  modified_base (170)..(170): a, c, t, g, unknown or other
  modified_base (355)..(355): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacattcacaggtccagatggtattctgattatgcagtgtctgtgagagtcgaatggacatcactacacgacccacgaagatcagttcctcctgctattcgactactctgtcgacctcccgganacacggctcgtctatactgtagtaagacactccacgacgggctaccacaccgtccgacccgtcgggaccgacggtaacctacggtaccaccgtctcctcacgccctaccaccgaacggccctacgtccggtcccgtccccgtcggccgccctcgccgtccgacggaccgaccacccgtacggaccgacgacccg

SEQ ID NO: 362015 - DNA, 577 bp, Homo sapiens
  misc_feature: GZ8MTXP02HJN73.21.86.H09.1.454.CMB.2.raw
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccaccgaagaatcagttctcctgcatttgcactctgtgactcccgacgaccacggctgtctactattgtagtaagacatcccacgacgggggtcctccacactccgaccccgtggggccacgggaaccctagtccaccgttcctcctcacgccctccaaccgacgggcccacgtccgtccctcccccgtcggcccgcccgtcgccctccgacggtcgccgaccctccggacgacggcacgacggcccggcccgtcgggcctcgccgtcggtacgaacggtcctaccgttacccggaccg

SEQ ID NO: 362016 - DNA, 336 bp, Homo sapiens
  misc_feature: GZ8MTXP02FMXM4.21.86.H09.1.454.CMB.2.raw
  modified_base (331)..(336): a, c, t, g, unknown or other
tcagtcgtcgctcgcacgaccggtgctcgatttagtgctatagacttgggtttgggggtgtggtggtctccactcccgctttgacggggctgctatctgcccgattctctggctccaagtctggcacctcagccaccctggtcatcagcgaactccagtccggggacgaggccatttattactgcggaacgtgggacagttccctgactgtcggggtgttcggcggagggaccacagtgaccgtcctaggtcagcccaaggctgccccctcggtcactctgttcccaccctcctccgagcgacgactgagcgggctggcaaggcgcatagnnnnnn

SEQ ID NO: 362017 - DNA, 581 bp, Homo sapiens
  misc_feature: GZ8MTXP02G64SJ.21.86.H09.1.454.CMB.2.raw
  modified_base (159)..(159): a, c, t, g, unknown or other
  modified_base (170)..(170): a, c, t, g, unknown or other
  modified_base (258)..(258): a, c, t, g, unknown or other
  modified_base (423)..(423): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattctacaggtccagatggtattcngattatgctagtgtctgtgagaagtcgaaatggacatcaactacacgaccccacgaagactcgagtttcctccctgtacctattttcgactacttctgtcgacctcccgacgaccacggtctagtctactattgtagtaagacactccgacgacgggctccgacncgtccgacccgtcgggaccgacggaccctagtccaccgtcctacctcgacgccctaccgaccgaaccgggaccctacgtcccggttcccttcccccgtcggtcccgtcccgtcgcccgtaacccgacggaccgtccacccgtaccggacgacgacccg

SEQ ID NO: 362018 - DNA, 569 bp, Homo sapiens
  misc_feature: GZ8MTXP02ISPMY.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagaagtcgaaatggacatcactacacgacccacgaagaatcagttcctcctgacctatttcgctactcttcgtgacctcccgacgacgacggctgtctactattgtagtaagacactacccacgtacggggcctaccgacaccgtaccgaccccgtcgggccgacgggaaccctacgtaccaccgtcctccgtcacgccctaccgaccgaacggccctacgtccgtcccttccccgttcggcccgtccccgtcgccgtccgacggacgaccgaccgtacccgacgacggaccg

SEQ ID NO: 362019 - DNA, 535 bp, Homo sapiens
  misc_feature: GZ8MTXP02FHB9B.21.86.H09.1.454.CMB.2.raw
  modified_base (328)..(328): a, c, t, g, unknown or other
  modified_base (343)..(343): a, c, t, g, unknown or other
  modified_base (496)..(496): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctggggaaggacattctacaggtccagatggtattctgattatgcagtgtctgtgagaagtcgaaatggacatcactacagacccacgagaatcagttctccngcattgcactctgtnacctcccgagacacggctgtctactattgtgtaagacatcccacgagggggctccacacctccgaccccgtggggccacgggaaccctagtcacccgtctcctcacgcctccaccaacgggcccatccggtccttcccccgcggccgtccccngccctcccgacggacgccgaccctccgaacgacgacccg

SEQ ID NO: 362020 - DNA, 558 bp, Homo sapiens
  misc_feature: GZ8MTXP02HJJB1.21.86.H09.1.454.CMB.2.raw
  modified_base (195)..(195): a, c, t, g, unknown or other
  modified_base (206)..(206): a, c, t, g, unknown or other
  modified_base (248)..(248): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttancaccactagtacttggaattggatcaggcagtccccgtgagnggcttgagtggctgggaagcattcacaggtccagatggtattctgattatgcagtgtctggtgagaagtcgaaatggacatcactacaccgacccacgaagatcagttctccctgactatttgctactctgtcgtacctacccgacgtacgacggtctcgtacctacttacttagtacgtaacgacactacccgacggacggggctaccacacgccgacccggtcgggccgacggacctacgtcctacgtcctcctcaccgtccaccgaccgaaccggccaacgtccgtcctcccgcgccgcctcgtccg

SEQ ID NO: 362021 - DNA, 591 bp, Homo sapiens
  misc_feature: GZ8MTXP02FTGCY.21.86.H09.1.454.CMB.2.raw
  modified_base (195)..(195): a, c, t, g, unknown or other
  modified_base (206)..(206): a, c, t, g, unknown or other
  modified_base (275)..(275): a, c, t, g, unknown or other
  modified_base (347)..(347): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagcattcanaggtccagatggtattctgattatgcagtgtctgtgagaagtcgaatggacatcactacacgacccacgaanactcagttctccctgactatttcgctactctgtcgacctcccgacgacgacggctcgtctactagttgtagtaacgacactacccacggacggggcctaccacaccgtaccgacccccggtcggggtacccgacgggtaaccctacgtcccacccggttcctaccctcgaccgtccctacccgaacccgacggaccccaacgttcccggtcccgttcccccgtcggcccgtcccgtcgtacccg

SEQ ID NO: 362022 - DNA, 536 bp, Homo sapiens
  misc_feature: GZ8MTXP02FRHBE.21.86.H09.1.454.CMB.2.raw
  modified_base (159)..(159): a, c, t, g, unknown or other
  modified_base (258)..(258): a, c, t, g, unknown or other
  modified_base (334)..(334): a, c, t, g, unknown or other
  modified_base (350)..(350): a, c, t, g, unknown or other
  modified_base (448)..(448): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattcngattatgcagtgtctgtgagagtcaatggacatcactacagacccacgaagatcagttctcctgctattgcactcngtcgactcccgagacncggctgctactattgtagtaagacatcccgacgacggggctccacactaccgacccgtcggggaccagtacgaaccctacgtccaccgtctcctcacncccgtaccaaccgacgggccctacgtccggtcccttccccgtcgccgccctcggcctcccgacggtacgaccaccgtccgacgaccgg

SEQ ID NO: 362023 - DNA, 638 bp, Homo sapiens
  misc_feature: GZ8MTXP02JD6SM.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcacaggtccagatggtattctgattatgcagtgtctgtgagtaagtcgaatggacatcactacacgacccacgaagactcagttcctccctgacctatttcgactacgtctgtcgacctcccggaacgaccgaccggcttcgtacttacttacgttgtacgtaagactactacccgacgacggggacctccaccgaccgtccgacccgtcggtaccggaccggaaccggtaacccgtacgtacctacgtccgtacccgtcctaccgtacccgtaccctaacccgacccggaacccggtacccgtacccggttacccgttccccgttcccccgtcccggtccccgtaccccgttccgacccgtacccggaccggaccgacccgtacccgtaccggaacccgg

SEQ ID NO: 362024 - DNA, 647 bp, Homo sapiens
  misc_feature: GZ8MTXP02H7M7O.21.86.H09.1.454.CMB.2.raw
  modified_base (161)..(161): a, c, t, g, unknown or other
  modified_base (172)..(172): a, c, t, g, unknown or other
  modified_base (270)..(270): a, c, t, g, unknown or other
  modified_base (277)..(277): a, c, t, g, unknown or other
  modified_base (325)..(325): a, c, t, g, unknown or other
  modified_base (335)..(335): a, c, t, g, unknown or other
tcagtcgtcgctcgcacgaccggtgctcgatttagtgctatagacttgggtttggagatcatgagggtgtcctgtcgcaaatacagctgcagcagtccggtccagggactggtgaagccctcgcagacccctctcactcacctgcgacatcgtccgggganagtatctttancaccactagtacttggaattggatcaggcacgtccccgtgagaggccttggagtggcgtaggggaagactattctacgaggtccagtatggtattcgngtattangctagtgtctgtgagagtacgaagtgacatcactacacgaccacgaanaatcagttcncctgctattcgactactctcgtcgacctaccgactaccgacgtctcgtactacttattgtagtaacgacacgtacccgacggacgggtcctaccgacaccgtacccggaccccggtacggggacccgtaaccgggtaaaccccgtacggtacccgtaccgttacctacccgtaccgaccgtccccaacccgaaacccgtaacccgggtacccgtaaccggttccccggttccccttacccccggtccggtccccgtcccctcggtacccgaaccggtacgacccgtaccacccgtaccggaacgacgacccg

SEQ ID NO: 362025 - DNA, 745 bp, Homo sapiens
  misc_feature: GZ8MTXP02HOG4Q.21.86.H09.1.454.CMB.2.raw
  modified_base (195)..(195): a, c, t, g, unknown or other
  modified_base (206)..(206): a, c, t, g, unknown or other
  modified_base (295)..(295): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttancacactagtacttgaattggatcagcagtcccgtgagagcttgagtggctgggaagacattcacaggtccagatggtattctgatttangctagtgtctgtgaagaagtcgaaatggacatcactacacgaccccaacgaagaatcgaagttcctccctgtcctagtttcgacctacgtctcgtacgtacctacccggaacgaccgaccgggtccttacggttacccttaacgtttacgtttagttacgtaaacgtaacctaaccgttacccgaacgggtaccgggggtacccttaccccgaacccgtaacccgttaccccggaacccccggttaccgggggtaacccccgaaaccgggggtaaacccccttaacgggtaccccgtaaccccgggttcccttaccccgttacccgacccggtacccccgtaccccgaaaccccggaaacccggggtcccccgtaaaccggtttccccgggttacccccgtttcccccccggtaccgggtccccccgtaccccgtttccggtacccccgg

SEQ ID NO: 362026 - DNA, 565 bp, Homo sapiens
  misc_feature: GZ8MTXP02ITMFZ.21.86.H09.1.454.CMB.2.raw
  modified_base (159)..(159): a, c, t, g, unknown or other
  modified_base (270)..(270): a, c, t, g, unknown or other
  modified_base (361)..(361): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgattatgcagtntctgtgagaagtcgaaatggacatcactacagaaccccagaagaaatcagttctcctgcatttgctactctgtcgactcccgaacgaaccncggtactgtactacgtattgtagtaagacactccgacgaggggctccacactccgacccgtcggggaccacgggaccctagtaccgaccgtcctacctcgacgtcccaccaaccgaaaccgggcccacgtccgtcccgttccccgtcggtccgccccgtcgccgtccgacggacggacccaccgtaccggaacgacggaacccg

SEQ ID NO: 362027 - DNA, 543 bp, Homo sapiens
  misc_feature: GZ8MTXP02GC8ZK.21.86.H09.1.454.CMB.2.raw
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgagaatcagttcncctgctatttgctactctgtcgacctcccgacgacacggctgtactactattgtagtaagacactacccacgacggggctccacactccgaccccgtcggggacccgacgggaaccctacgtaccacccgtcctccctcacgcctaccaccgaacggcccacgtccgtcctccccgtcgcccgtcctcgcctccgacggacgccaccgtccgacgacgaccg

SEQ ID NO: 362028 - DNA, 543 bp, Homo sapiens
  misc_feature: GZ8MTXP02IYRHV.21.86.H09.1.454.CMB.2.raw
  modified_base (356)..(356): a, c, t, g, unknown or other
tcagtcgtcgctcgcacgaccggtgctcgatttagtgctatagacttggggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacagggtccagatggtattctgattatgcagtgtctgtgagaagtcgaatggacatcactacagaccaccgaagaatcagttctcctgcatttgcactctgtgactcccgacgacaacggctgtctactatgtgtaagacnctccacacgggggctccacactccgaccctcggggaccacgggaccctacgtcaccgtctcctcacgcctcaccacggcccacgtcggtccttcccgtcggccgccgtcgctccaggacgccaccgtccgacgacgcacgacgccggccgtcggctcgacgtcgcgaacggcctacgttcccgacgg

SEQ ID NO: 362029 - DNA, 605 bp, Homo sapiens
  misc_feature: GZ8MTXP02JA1UW.21.86.H09.1.454.CMB.2.raw
  modified_base (159)..(159): a, c, t, g, unknown or other
  modified_base (309)..(309): a, c, t, g, unknown or other
  modified_base (321)..(321): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattcacaggtccagatggtattctgattatgcagtgtctgtgagagtcgaatggacagtcatacagacccacgaanatcagtctcctnactattcgctactctgtcgacctccgtaacgccacggcttagtctactattgtagtaacgacactacccgacggacggggtcctaccgacctaccgtacccggaccccggttccgggggacccggtaaccgggaaccccgttacggtacccgaacccgttccgtcctccgtaccgcccctaccgaacccgaacgggccctaccgtcccggttccctccccgtcggcccgtcccgtccgtcccgtcccggacggaccgacccgacccgtaccggacgacgacccg

SEQ ID NO: 362030 - DNA, 612 bp, Homo sapiens
  misc_feature: GZ8MTXP02I8CO2.21.86.H09.1.454.CMB.2.raw
  modified_base (274)..(274): a, c, t, g, unknown or other
  modified_base (357)..(357): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaagacattcacaggtccagatggtattctgattatgcagtgtcngtgagaagtcgaatggacatcactacagacccacgaagatcagttcctcctgacctatttcgctactctgcgacctcccgganaccgacggctacgtctactattgtgtaacgacactcccacgtacggggctaccgacctaccgtaccgaccccggtcggggacccgaacgggtaaccccgtacggtacccgtacccgtccgttaccgtaccgacgtccctacccgaaccgtaaccgggtacccctacgttcccggttcccgtttcccccgtcggtcccgtccccgttccggcccgtcccgacggacgtaccgacccgtcccggacgtacggacccg

SEQ ID NO: 362031 - DNA, 529 bp, Homo sapiens
  misc_feature: GZ8MTXP02IP7PZ.21.86.H09.1.454.CMB.2.raw
  modified_base (159)..(159): a, c, t, g, unknown or other
  modified_base (323)..(323): a, c, t, g, unknown or other
  modified_base (356)..(356): a, c, t, g, unknown or other
  modified_base (437)..(437): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagagtcgaatggacatcactacagacccacgaagatcagttctccngcattgctactctgtgacctccgacgacacggntacgtctactattgtagtaagacatccacgacggggctccacactcgacccgtgggccgacggaccctagtaccaccgtcncctcacgcctaccaccgaacggcccacgtccggtccttccccgtcggccgtcccgcgtcctccgacggacgccacccgtccgacgacgaccg

SEQ ID NO: 362032 - DNA, 692 bp, Homo sapiens
  misc_feature: GZ8MTXP02J0NZE.21.86.H09.1.454.CMB.2.raw
  modified_base (195)..(195): a, c, t, g, unknown or other
  modified_base (206)..(206): a, c, t, g, unknown or other
  modified_base (270)..(270): a, c, t, g, unknown or other
  modified_base (275)..(275): a, c, t, g, unknown or other
  modified_base (291)..(291): a, c, t, g, unknown or other
  modified_base (298)..(298): a, c, t, g, unknown or other
  modified_base (360)..(360): a, c, t, g, unknown or other
  modified_base (377)..(377): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttancaccatagtacttggaattggatcaggcagtccccgtgagaggccttgagtggctgggaagacnttcanaggtcagatggtatcngatttangcagtgtactggtagacgtaagtcgaaatggactatcactaacaccggacccccaaggaaanaacttcaacgtttcccncccgtgtacttattcgacctacgttcgtcgtaccgtacccgtacccgaacgaccgtacggtcttcgtaccttaacgttagttacgtagtaacgtacctaccgtacccgacgggtacgggtacctaccgaaccgtacccgtaccccggtacccgggtacggggaacccgtaaccgggtaacccgtaccgtacccgtacccggtaccctacccgtaccgtacccgtacccgtacccgaacccgtaacccggtacccgtaacccgtacccggttaccccgttacccccgtacccggtacccggtcccgtaccgtaccg

SEQ ID NO: 362033 - DNA, 544 bp, Homo sapiens
  misc_feature: GZ8MTXP02IELG9.21.86.H09.1.454.CMB.2.raw
  modified_base (265)..(265): a, c, t, g, unknown or other
  modified_base (300)..(300): a, c, t, g, unknown or other
  modified_base (372)..(372): a, c, t, g, unknown or other
  modified_base (447)..(447): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaagcattctacaggtccagatggtattctgattangcagtgtctgtgagaatcgaaatggacatcactanagacccacgaagaatcagttctcctgactatttgcactctgtgacctccgacacacggctgtctactatgtntaagacatccacgagggctccacactcgacccgtcgggccacgggaaccctagtccctaccgtactcctccgacnccaccgaccgaaccggacccgaccgtccgttcccgttccccgtccgcccgcccgtccgtccgtccgtacggacgaccgacccgtaccgacgacgacg

SEQ ID NO: 362034 - DNA, 545 bp, Homo sapiens
  misc_feature: GZ8MTXP02GHI2M.21.86.H09.1.454.CMB.2.raw
  modified_base (310)..(310): a, c, t, g, unknown or other
  modified_base (356)..(356): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattcacaggtccagatggtattctgattatgctagtgtctgtgagagtcgaatgacatcactacacgacccacgaanatcagttcctcctgctatttgctactctgtcgacctcccgacgacncggtctgtctactattgtagtaagacactcccgacgacggggcctccaccacctacccggacccgtcggggaccgacgggaaccctacgtccacccgtcctcctcacgccctaccaccgacggcccacgtccgtcccttcccgcgccgccctcgcctccgacggacgccgaccgtaccgacgacgaccg

SEQ ID NO: 362035 - DNA, 551 bp, Homo sapiens
  misc_feature: GZ8MTXP02GFISI.21.86.H09.1.454.CMB.2.raw
  modified_base (297)..(297): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccaccgaagaatcagttcncctgcatttgcactctgtgactccgacgacacggctgtctactattgtgtaagacatcccacgacgggggctccgacactccgaccccgtcggggaccacgggaaccctagtccacccgtctccctcacgccctccaccaacgggcccactccggtccttcccccgtcggcccgccctcgccgtccacggacgcaccctccgacgacgcacacgcgcccgtggcgtcgcctcggtcacggactaccgtccgacg

SEQ ID NO: 362036 - DNA, 603 bp, Homo sapiens
  misc_feature: GZ8MTXP02JZVY0.21.86.H09.1.454.CMB.2.raw
  modified_base (159)..(159): a, c, t, g, unknown or other
  modified_base (384)..(384): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccaggganagtatctttatcaccactagtacttggaattggatcaggatcccgtccgagaggctgagtggcgtgggaaggacattctacaggtccagatggtattctgattatgcagtgtctgtgagaagtcgaatggacatcactacacgaacccacccgaagaatcagttctccctacgctatttcgccactccttgtcggacctccccgacgacgacgctgtctaacttnttagtcgtaaagacacgtcccacgaagggggtcctccacactcccggacccccgtgggggacccgacggggacccctaggtaccacccgtccgtcctccgacgccctacccaccgaaacggggccccacgttccggtccctttaccccccgcggtcccgcccccgttgcccgtaacccgacgggaacggccctaaccccggtccgaaaggcgaaccccg

SEQ ID NO: 362037 - DNA, 604 bp, Homo sapiens
  misc_feature: GZ8MTXP02FHX73.21.86.H09.1.454.CMB.2.raw
  modified_base (159)..(159): a, c, t, g, unknown or other
  modified_base (170)..(170): a, c, t, g, unknown or other
  modified_base (208)..(208): a, c, t, g, unknown or other
  modified_base (524)..(524): a, c, t, g, unknown or other
  modified_base (569)..(569): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtcctcgngagcgtctgagtgcgtagggaagatatcagcgtcagtgtagtattctgtattagtgctagtcgtcgtggagaaggtaacgtacgaagtcggaatactaccaactaacgaccgaaccccgaaacggaaatactcgtacgtttccaccccgtgacttagtttcgactccttgtcgacgaccctaccggacgaacgcggtctcgttactacttagttgtaagtaacgactaccacccgacgggacgggcctaccgactaccgtcccgacccggtcgggaccgaccggtaaccgtacgcccgtaccgtcctcctcgaccnccctacccaacggaccgcctacgtcccgtcccctcccgcgtcccnccgtcgccgacgacggcaccgaccgacgacgaccg

SEQ ID NO: 362038 - DNA, 556 bp, Homo sapiens
  misc_feature: GZ8MTXP02GMKIJ.21.86.H09.1.454.CMB.2.raw
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcggaccctctcactcacctgcgacatcgtccggggagagtatctttatcaccactagtacttggaattggatcaggcagtccccgtgagaggccttgagtggctggggaaggacattcacaggtccagatggtatctgattatgcagtgtctgtgagaagtcgaatggacatcactacacgacccccacgaagaactctagttcctcttgctatttcgctactctgtcgactccgacgacacgctgtctactatgtagtagacactccacgacgggggctccacgactacccgacccgtcgggccgaacgggaccctagtccaccgtcctcctcacgcctccaccgaacgggccctacgtccggtcccgttcccctcggccgtcccgtcgcctaccg

SEQ ID NO: 362039 - DNA, 549 bp, Homo sapiens
  misc_feature: GZ8MTXP02G8QBC.21.86.H09.1.454.CMB.2.raw
  modified_base (196)..(196): a, c, t, g, unknown or other
  modified_base (206)..(206): a, c, t, g, unknown or other
  modified_base (352)..(352): a, c, t, g, unknown or other
  modified_base (362)..(362): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatcttancaccactagtacttggaattggatcaggcagtccccgtgagaggccttgagtggcgtgggaagacattcacaggtccagatggtattctgatttatgcagtgtctgtgagaagtcgaaatggacatcactacacgaccccacgaanatctagttcncctgctatttgctactctgtcgactcccgacgacacggctgtctactattgtagtaagacactccacgacggggctaccacacgtccgacccgtcgggccgacggacctacgctaccgtcctcctcacgccctccgaaccgacggacccaacgtccgtcctccccgtcggcccgtcccgtcgtcccg

SEQ ID NO: 362040 - DNA, 634 bp, Homo sapiens
  misc_feature: GZ8MTXP02FTCBV.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctggggaagacattctacgaggtccagatggtattctgattatgcagtgtctgtgagaagtcgaatggacatcaactacacgaaccccacgaagaactcagttcctcctgcctatttgctactctgtcgacctcccgacgaccacggtcttgtacttacttagttgtagtaacgactacgtacccacggacgggggtcctaccgacctaccgtacccggaccccggtaccggggacccgaaccggggtaacccctacggtaccctaaccccgtcctaccctccgaccggtccctacccgaaccccgaacgggaccccctacgttcccggttcccgttcccccgtcggccccgtccccgtcgtcccgtaacccgacggaccgacccgacccgtacccggacgacgaacccg

SEQ ID NO: 362041 - DNA, 560 bp, Homo sapiens
  misc_feature: GZ8MTXP02FINL4.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattcacaggtccagatggtatctgattatgcagtgtctgtgagaagtcgaatggacatcactacacgacccacgaagaactcagttcctcctgctatttgcactcttgtcgacctcccgagaccacggcttgtctacttattgtagtaagacactcccacgacgggggcctccacaccgtccgaccccgtcgggcccgacgggtaaccctacgtccgacccgtcctcctcgacgccctaccgaccgaacgggaccctacgtccggtacccttcccccgtcggccgtccctcgtcctccgacggacgccacccgtccgacgacgaccg

SEQ ID NO: 362042 - DNA, 563 bp, Homo sapiens
  misc_feature: GZ8MTXP02GVDLF.21.86.H09.1.454.CMB.2.raw
  modified_base (353)..(353): a, c, t, g, unknown or other
  modified_base (360)..(360): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattatgcagtgtctgtgagaagtcgaatggacatcactacagacccaccgaagaatcagttctccctgcatttcgctactctgtgactcccgacgacacggctcgtctactattgtntaagacnctcccacgagggggcctaccacactccgaccccgtggggcccgagggaaccctagtccaccgtccgtcctcacgcctccaccgacgggcccactccgtcccttcccccgcgcccgccctcgcctccgacggcgcgaccctacgacgacgcacgacgccgcccgtggcctcgcgttcggacgacggactaccgtccgtaaccgg

SEQ ID NO: 362043 - DNA, 556 bp, Homo sapiens
  misc_feature: GZ8MTXP02I0FOH.21.86.H09.1.454.CMB.2.raw
  modified_base (195)..(195): a, c, t, g, unknown or other
  modified_base (206)..(206): a, c, t, g, unknown or other
  modified_base (271)..(271): a, c, t, g, unknown or other
  modified_base (275)..(275): a, c, t, g, unknown or other
  modified_base (299)..(299): a, c, t, g, unknown or other
  modified_base (313)..(313): a, c, t, g, unknown or other
  modified_base (318)..(318): a, c, t, g, unknown or other
  modified_base (333)..(333): a, c, t, g, unknown or other
  modified_base (518)..(518): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacntcanaggtccagatggtatctagattangcagtgtctgtganaagtnaatggacatcatacncaccacgaagatcagttctcctgactatttgcctactctagtacgacctacccgacgacgacgctgtcctactattgtagtaagacactaccacgacgggcctaccacaacctccgacccgtcgggacgacggaaccgtacgtccaccgtcgtaccctcgacgcctaccgaaccgaacggacccncgtcccgtccgttccccgtcgcccgtcccgttcgcccg

SEQ ID NO: 362044 - DNA, 558 bp, Homo sapiens
  misc_feature: GZ8MTXP02INUGQ.21.86.H09.1.454.CMB.2.raw
  modified_base (421)..(421): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattatgcagtgtctgtgagaagtcgaatggacatcactacacgaccaccgaagaatcagttctcctgcatttgcactctgtgactcccgacgacacggctcgtctactattcgtgtagcactcccagacggggctacacactccgacccgtggggacccacgggaacctacgtcaccgtctcctcngcctccaccgacggccacgtcggtcccttcccccgtcggccgtccctcgcctccgaggtacgccacccgtccggacgacgccacgacggccggccgtcggccgtgccgtcggtacacgggactaccgttaccgacgg

SEQ ID NO: 362045 - DNA, 738 bp, Homo sapiens
  misc_feature: GZ8MTXP02IW36T.21.86.H09.1.454.CMB.2.raw
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatctccggggagagtatctttatcaccactagtacttggaattggatcaggcagtccccgtgagaggccttgagtggctgggaagcattctacgaggtccagatggtattcagattangcagttgtctggtgaagaagtcgaaatggacatccactacacgaccccacgaagtaactctagttctccctgctatttcgactactctcgtcgtaccctcccgacgaccgaccgggtcttacggtaccttaacgttagtttacggtagttaaacgacctaaccgttaccccgaacgggtaacgggggtacccttacccgaacccgtacccggtaccccgggtaaacccccgggttccggggggaacccccggtaacgggggtaaacccccgttacggttacccccgaaccccggtttcccgtaccccgttacccacccgggtacccctaccccgaaacccgggtaaacccgggtaccccgtaaccggttaccccggtttcccccgttaccccccggtccgggtaccccgtcccccgtccggtacccgtccgaccggaccgtacccgaacccgtcccggacggtacgacccgg

SEQ ID NO: 362046 - DNA, 703 bp, Homo sapiens
  misc_feature: GZ8MTXP02HOYTO.21.86.H09.1.454.CMB.2.raw
  modified_base (172)..(172): a, c, t, g, unknown or other
  modified_base (273)..(273): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatcgtccggggagagtatctttancaccactagtacttggaattggatcaggcacgtccccgtcgagaggccttgagtggcgtggggaaggacattctacgaggtccagatggtattctgattangcagtgtctggtgaagaagtcgaaagtcggacaatccaactaaccgaacgaaccccgaaacgaaagtaactcgtacgttcctccctgacctatttcgactacttcgtgtcgaccgtacccgaacgaccgacggtcttacgtaccttacttattacggttagtaacgactactacccgacggacggggtccctacccgaccgtaccgtacccggacccccggtacggggacccgtaaccgggaccccgttaccggtaccctacccgtacctcccgtaccgtaccgacccctacccccggaaacccgaaacccggggtcccctaacccggttccccgggttcccccgttccccccggtcggtcccccgtcccccgttcgtcccgtaacccggacggaccgacccgaccccgtacccggacgaacgtaccccg

SEQ ID NO: 362047 - DNA, 585 bp, Homo sapiens
  misc_feature: GZ8MTXP02FH1AW.21.86.H09.1.454.CMB.2.raw
  modified_base (257)..(257): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtcccgtgagaggccttgagtggctgggaagcattcacaggtccagatggtattcngattatgcagtgtctgtgagaagtcgaaatggacatcactacacgacccacgaagaatcagttcctcctgcctatttgctactctgtcgaccctcccgaagaccaggcttgtactactattgtagtaaacgacactacccgacgacggggcctccaccaccgtaccggacccccgtcggggacccgaacggggaacccctacggtccctacccgttcctaccctccgacgaccctacccaccgaaccggcccacgttcccggtcccttcccccgtcggcccgccccgtcgcccgtccgacggacgacctacccgaccgacgacgaccg

SEQ ID NO: 362048 - DNA, 568 bp, Homo sapiens
  misc_feature: GZ8MTXP02F9P9Q.21.86.H09.1.454.CMB.2.raw
  modified_base (133)..(133): a, c, t, g, unknown or other
  modified_base (428)..(428): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttatcaccactagtacttggaattggatcaggcagtccccgtgagaggccttggagtggctggggaagcattctacaggtccagatggtattctgattatgcagtgtctgtgagaagtcgaatggacatcactacagaccaaccgaagaatcagttactcctgcatttgcactctgtgactcccgacgacgacgctgtctactattgtgtaagacatccacagggggctccacactcgacccgtcgggcccacgggaaccctaggtccaccgtcctcctacacgcccnccaaaccgaacgggacccaacgtccggtcccttcccccgtcgcccgtccctcgcctccgaggacgccacctaccgacgacgacacgaacgccggcccgtggccgcgccgttcggacaacggactaccgttaccgaaccgg

SEQ ID NO: 362049 - DNA, 583 bp, Homo sapiens
  misc_feature: GZ8MTXP02GPOWX.21.86.H09.1.454.CMB.2.raw
  modified_base (134)..(134): a, c, t, g, unknown or other
  modified_base (358)..(358): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccgggganagtatctttatcaccactagtacttggaattggatcaggcagtccccgtgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctcgtctactattgtgtaagacnctcccacgaggggctccacactccgacccgtgggccgacgggaacctacgtccaccgtctcctcacgccctaccaccgaacggcccacgtccggtccttcccccgcggccgcccctcgcctccgacgacgccacctccgacgacgcaaacgcggcccggtcccgtcgggcctccggtcccgtacggtaccgtaaacgggtaccctaccggtttacccgaaccggg

SEQ ID NO: 362050 - DNA, 535 bp, Homo sapiens
  misc_feature: GZ8MTXP02HLVNR.21.86.H09.1.454.CMB.2.raw
  modified_base (159)..(159): a, c, t, g, unknown or other
  modified_base (322)..(322): a, c, t, g, unknown or other
  modified_base (455)..(455): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaaatggacatcactacagacccacgaagatcagttcncctgccatttgcctactcgtgtcacctcccgacgaccacgggtctgtctacttattcgtataagactatcccacgacggggctccacacgtcgaccccgtgggccgacggaccctagtccaccgtcctcctcncgcctccgacgaacggcccacgtccgtccctcccgtcggccgccctcgctccgcggacgcctaccgccgacgacgacccg

SEQ ID NO: 362051 - DNA, 569 bp, Homo sapiens
  misc_feature: GZ8MTXP02JMT7O.21.86.H09.1.454.CMB.2.raw
  modified_base (314)..(314): a, c, t, g, unknown or other
  modified_base (351)..(351): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagaccaccgaagaatcagtctcctgcatttgcactctgtnactcccgacgacacgctcgtctactattgtgtagacnctccacgaggggctccacacctcgaccccgtcgggaccgacgggaccctagtcgaccgtcctcctcacgccctcccaccgtacgggcccacgtccgtccttcccccgtcggccgccctcgcctccgaggcgcacccgtccgacgacgcaccgacggcccgcccgtcggggcctcggtcccgtcggtacgaacggaccgttaaccgttcccggaaccgg

SEQ ID NO: 362052 - DNA, 513 bp, Homo sapiens
  misc_feature: GZ8MTXP02IML5R.21.86.H09.1.454.CMB.2.raw
  modified_base (259)..(259): a, c, t, g, unknown or other
  modified_base (444)..(444): a, c, t, g, unknown or other
  modified_base (485)..(485): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaagacattcacaggtccagatggtattcngattatgcagtgtctgtgagaagtcgaatggacatcactacagacccacgaagatcagttctcctgcatttgcactctgtcgacctcccgacgacacggctagtctactattgtataagacatcccacgaggggctccacactccgacccgtgggccagtcgaacctagccacctctcctcaccnccaccaccgacgaccgctccgtccgtcccgtcgccgccgcncgcgacgacgaccgaccgaccgacgacg

SEQ ID NO: 362053 - DNA, 551 bp, Homo sapiens
  misc_feature: GZ8MTXP02H18S4.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggctgggaagacattctacaggtccagatggtattctgtattatgcagtgtctgtgagagtcgaatgacatcatacacgacccacgaagatcagttctcctgctatttgctactctgtcgacctccgacgacacggtctgtctactattgtgtaagactatcccacgacggggcctaccacacctaccgaccccgtacggggacccgaacgggaacccgtacgtccacccgtcctcctcaccgtcctaccaccgaacggccctacgtccgtcccttccccgtcggcccgcccgtcgcctccgacggacgctacccgacgacgacgacc

SEQ ID NO: 362054 - DNA, 525 bp, Homo sapiens
  misc_feature: GZ8MTXP02FQTO5.21.86.H09.1.454.CMB.2.raw
  modified_base (353)..(353): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccaccgaagaatcagttctcctgcatttgcactctgtgactccgacgacacggctgtctactattgtgtaagacntcccacagggggctccacactcgaccctggggccagggaaccctagtcaccgctcctcagcctccaccacgggcccatccgtcttcccctgccgccctgctccaggacgcacctccgagacgcacacgccggccctgggcctgcctcggtcaacggactacgttccgaacgg

SEQ ID NO: 362055 - DNA, 662 bp, Homo sapiens
  misc_feature: GZ8MTXP02FMIHT.21.86.H09.1.454.CMB.2.raw
  modified_base (160)..(160): a, c, t, g, unknown or other
  modified_base (171)..(171): a, c, t, g, unknown or other
  modified_base (262)..(262): a, c, t, g, unknown or other
  modified_base (269)..(269): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcaggcacgtccccgtgagaggccttgagtggcgtgggaagacattcacgaggtccagatggtattcngtattangcagtgtctgtgaagagtacgaagtggaactatcaactacacgtaaccccaacgaaagtaactccagttccctaccgtgactagtttcgcctactctgtcgacctcccgacgaccgacggtcttcgtacttacttagttagtagtaacgactaccgtacccgacggtacggggaccttacccgaccgtacccgttacccggaccccggtacggggacccgaaccgggtaaccccgttaccgtacccgtaccccgtccctacccgtaccgtacccgcccgtacccgaacccgaaccggtacccctacggttcccggttccccgttcccccgtccggtccccgtcccgtcgacccgtaaccgacggaccgcccgtaccgtaccgacgacgacccg

SEQ ID NO: 362056 - DNA, 555 bp, Homo sapiens
  misc_feature: GZ8MTXP02GXHKE.21.86.H09.1.454.CMB.2.raw
  modified_base (467)..(467): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacaggtccagatggtattctgattatgcagtgtctgtgagagtcgaatggacatcatacagacccacgaagatcagttctcctgcctatttcgactactctgtcgacctcccgacgacacggctgtctactagttcgtagtaagactactcccgacgacggggctccgaccaccgtccgacccgtcgggacccgacgggaccctacgccaccgtctcctcgacgtcccnccaccgacggaccctacgtccggtcccttcccccgtcggtccgccctcggtcctaaccgacggacgccgacccgtccgacgacgaccg

SEQ ID NO: 362057 - DNA, 557 bp, Homo sapiens
  misc_feature: GZ8MTXP02ISWIP.21.86.H09.1.454.CMB.2.raw
  modified_base (366)..(366): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttgagtggcgtgggaagctattctacaggtccagatggtattctgattatgcagtgtctgtgagagtcgaagtggacatcatacacgaccccacgaagactctacgttctccctgctatttgactacttctgtcgacctcccgacgacncggctgtctactatgtagaacgactactaccgacgcggggcctacacacgtccgaccccgtgggaccgtacggaccctacgcccaccgtcctctaccacgccctaccgaccgacgcccgactcccggtcccttaccccgcggtcccgccctcgcctaaccgacggaccgaccaccgtccgacgacgacccg

SEQ ID NO: 362058 - DNA, 561 bp, Homo sapiens
  misc_feature: GZ8MTXP02GZWEV.21.86.H09.1.454.CMB.2.raw
  modified_base (134)..(134): a, c, t, g, unknown or other
  modified_base (353)..(353): a, c, t, g, unknown or other
  modified_base (464)..(464): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagaatcagttctcctgcatttgcactctgtgactccgacgacgcggctcgtctactatgtgtaagacntcccagacggggctccacacctccgacccgtgggacccgacgggaaccctgtaccaccgtcctcctcacgcctaccaaccgtacggccacgtcgtccttcccccgtcgccncccgtcgcctccgacggacgccacccgtccgagacgacacgacgccggcccgtcggcctcgccgtcggtaccgaacggaccttaccgtcccgaacgg

SEQ ID NO: 362059 - DNA, 612 bp, Homo sapiens
  misc_feature: GZ8MTXP02HKWJT.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattcacaggtccagtatggtattctgattatgctagtgtctgtgaagaagtcgaaagtggaacatacaactaacacgaaccccaacgaaagaactctaagttcctcctgctatttcgctactctgtcgacctcccgacgaccacggtctgtactactattgtagtaacgacactccgacgacggggctaccgacctaccgtacccgaccccgtcgggacctacgtaccgtaacccgtacgtacccgacccgtcctcccgtcaccgtaccctacccgaacccgaaccggaccccgtaccgttcccggtccccgttcccccgtccggcccgtcccgtcgtcccgtaccgacgggaccaccgaacccgtccgaacgacccg

SEQ ID NO: 362060 - DNA, 591 bp, Homo sapiens
  misc_feature: GZ8MTXP02J28OY.21.86.H09.1.454.CMB.2.raw
  modified_base (144)..(144): a, c, t, g, unknown or other
  modified_base (232)..(232): a, c, t, g, unknown or other
  modified_base (238)..(238): a, c, t, g, unknown or other
  modified_base (364)..(364): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttancaccactagtacttggaattggatcaggcagtccccgtgagaggccttgagtggctgggaagcattctacaggtccagatggtattcngattangcagtgtctgtgagaagtcgaatggacatcactacagacccacgaagaatcagttctccctgctatttgcactctgtcgacctcccgacgtacgacggctccgtactactagttgtagtaacgacnctcccaacggtacggggctacccgacaccgtcccgaccccgtacgggggcccaacgggaaccctacgtccgaccggtctccctcaccgcccaccaccgaacggcccacgtccggtcctccccgtgcccgcccgtcgccctccgacgacgaccgacccaccggacgacgccgacacggtccgcccgtcggctcggccgtcgacaacggtacctaccgtaccgaaccgg

SEQ ID NO: 362061 - DNA, 690 bp, Homo sapiens
  misc_feature: GZ8MTXP02JMYZH.21.86.H09.1.454.CMB.2.raw
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcagtgtctgtgagaagtcgaatggacatcactacagacccacgaagaatcagttctcctgctatttcgactactctgtcgacctcccgacgacacggctcgtctactacttgtgtaagacactcccaacggacgggggccctaccaaccgtaccgtacccggaaccccggtccggggaacccggaaccggggtaaacccttacgtacccgtacccgttcccgtaccctacgacccgccccttacccgaaaccccggaacccggtaccccgtaacgttccccggttacccccgttcccccggtcccggccccgtccccgtccgtaccccgttaccgaccgggtaccgacccgaacccgtccggacgacgaccgaccggaccggcccggtccggtccggccgtccggccgttacggtaccgaacggtacccttaaccgtaccggaacccgg

SEQ ID NO: 362062 - DNA, 572 bp, Homo sapiens
  misc_feature: GZ8MTXP02GIV8B.21.86.H09.1.454.CMB.2.raw
  modified_base (357)..(357): a, c, t, g, unknown or other
tcagtcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaaggacattctacaggtccagatggtattctgattatgcagtgtctgtgagaagtcgaatggacatcactacagacccaccgaagaatcagttctcctgcatttgcactctgtgactcccgacgacacggctcgtctactattgtgtaagacnctcccacgacgggggctccacactccgaccccgtggggccacgggaaccctagtcaccgtctcctcacgcctccaccgaacggcccactccggtccttccccgtcggcccgccctcgcctccgacggacgaccaccctccgagacggacaccacggccggcccgtcgggcctcggcccgtacggtaccgaacgggacctaccgttcccgaaccgg

SEQ ID NO: 362063 - DNA, 555 bp, Homo sapiens
  misc_feature: GZ8MTXP02IRRZ2.21.86.H09.1.454.CMB.2.raw
  modified_base (322)..(322): a, c, t, g, unknown or other
  modified_base (359)..(359): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatcgtccggggagagtatctttatcaccactagtacttggaattggatcaggcagtccccgtgagaggccttgagtggctgggaagacattctacaggtccagatggtattctgattatgcagtgtctgtgagagtcgaatggacatcactacagacccacgaagatcagttcncctgcatttgctactctgtgacctccgacgacacggntgtctactatgtataagacactccgacgacggggctccgacaccgtccgaccccgtcggggacccgacgggtaacccctagtacccgacccgtcctaccgtcacgccctaccgaccgaccgggacccacgtccggtccttcccccgtcggcccgcccgtcgccgtccgacggacgccgaccgtccgacgacgaccg

SEQ ID NO: 362064 - DNA, 549 bp, Homo sapiens
  misc_feature: GZ8MTXP02JDAL6.21.86.H09.1.454.CMB.2.raw
  modified_base (213)..(213): a, c, t, g, unknown or other
  modified_base (294)..(294): a, c, t, g, unknown or other
  modified_base (351)..(351): a, c, t, g, unknown or other
  modified_base (489)..(489): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtgagaggccttgagtggctgggaagcattcanaggtccagatggtattctgattatgcagtgtctgtgagagtcgaatggacatcactacagacccaccgaagaatcagttcncctgcatttgcactctgtgactcccgacgacacggctgtctactattgtgtaagacntcccacgagggggcctccacactccgacccccgtggggacccacgggaaccctacgtccacccgtctacctcacgcctccaccgaaacgggcccagtccgtccttccccgtcggccgcctcgcctcacgacgccaccnccgacgacgcacgacgccgcccgtggctcgccgtcggtacacggactaccgtccgaacgg

SEQ ID NO: 362065 - DNA, 552 bp, Homo sapiens
  misc_feature: GZ8MTXP02IDQZE.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaagacattctacaggtccagatggtattctgattatgcagtgtctgtgagaagtcgaatggacatcatacagacccacgaagaatcagttctcctgctattcgcactctgtgacctcccgacgacacggtctgtctactattgtgtaagacactaccacgacggggctaccacactccgtaccccgtcggggacccgacgggaccctacgtccacccgtctacctcacgcctaccaccaacgggccctacgtcccgtccttccccgcggccgtccccgtcgtcccgtccgacggacgcccgacccgtaccggacgacgaccg

SEQ ID NO: 362066 - DNA, 539 bp, Homo sapiens
  misc_feature: GZ8MTXP02HUHEY.21.86.H09.1.454.CMB.2.raw
  modified_base (160)..(160): a, c, t, g, unknown or other
  modified_base (171)..(171): a, c, t, g, unknown or other
  modified_base (241)..(241): a, c, t, g, unknown or other
  modified_base (325)..(325): a, c, t, g, unknown or other
  modified_base (455)..(455): a, c, t, g, unknown or other
  modified_base (460)..(460): a, c, t, g, unknown or other
  modified_base (462)..(462): a, c, t, g, unknown or other
  modified_base (511)..(511): a, c, t, g, unknown or other
  modified_base (522)..(522): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagaccctctcactcacctgcgacatctccgggganagtatctttancaccatagtacttggaattggatcaggcagtccccgtgagaggccttgagtggctgggaagacattctanaggtccagatggtattctgattatgcagtgtctgtgagaagtcgaaatggacatcaactacacgacccacgaagaatcagttcncctgcatttcgcacttctgtgactcccgagaccacggctagttctactattgtgtaaagacactacccacgaggggcctccaacacctccgaccccgtgggacccgaaggaaccctacgtccaccgtccncctcncnccaccaccgaacggaccacgttccggcctttccccgcgccgccctcgcnccgacggaccnccaccgccgacgacacg

SEQ ID NO: 362067 - DNA, 565 bp, Homo sapiens
  misc_feature: GZ8MTXP02FXMOU.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagacattctacaggtccagatggtattctgattatgcacgtgtctgtgagaagtcgaaatggacatcactacagacccacgaagaatcagttctcctgctatttgctactctgtgactcccgagacacggctgtctactattgtagtaagacactacccacgacgggggcctccgacacctaccggaccccgtcggggaccctacggtacgaaacccgtacgtaccctaccgtcctcccgtacgacgccctacccgaacccgaacgggcccacgtccggtcccttcccccgtcgccgcccgtcgccgtccgacggacgccaccgtccgacgaccg

SEQ ID NO: 362068 - DNA, 709 bp, Homo sapiens
  misc_feature: GZ8MTXP02IW5QT.21.86.H09.1.454.CMB.2.raw
  modified_base (159)..(159): a, c, t, g, unknown or other
  modified_base (269)..(269): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcacgtccccgtgagaggccttgagtggctagggaagacattctacgaggtccagatggtattcgtgattangcagtgtactgtagaagtaagtcgaagtggacatacactacacgaaccccaacgaatactctacgtctcctgactatttcgctactcgtgtcgaccctccgacgaccgacggtctcgttactacttagttagtaacgtaacgacctacgtacccgacggacggggtcctaccgaccgtaccgtacccggaccccggttacggggaaccccggtaacgggtaaaccccgttacggtaccccgtaacccggttcctacccgttaccgaccggtacccccttacccgaaccccgaaacccgggtaccccgtaccggttaccccgggtttcccccgttccccccggtacccgggtacccccgtcccccgttccggtaccccgttaaccccggaacggtacccggaccccgttaaccccggacccggaaccggaccgaaccccgg

SEQ ID NO: 362069 - DNA, 609 bp, Homo sapiens
  misc_feature: GZ8MTXP02I5HFE.21.86.H09.1.454.CMB.2.raw
  modified_base (196)..(196): a, c, t, g, unknown or other
  modified_base (358)..(358): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagacggccttgagtggctgggaagactattctacaggtccagtagtggtattctagatttatgctagtgtctgtgagtaagtcgatggacagtcactacaccgaccacgaanactctacgttctcctgcttattgctatcgtgtctaccgtccgacgacgacggtctagtacttagttacgttagtagtaacgacgacctcccgaacggacggggtcctaccgtacccgaccgtacccggaacccggtcgggaacccgaccgggtaaccgtacgtcccgaccgtccctcctaccgaccgacccacccgaaaccgccggtaccctcgtcccgttcccttccccgcggtcccgtccgtcgtcccg

SEQ ID NO: 362070 - DNA, 656 bp, Homo sapiens
  misc_feature: GZ8MTXP02FPD41.21.86.H09.1.454.CMB.2.raw
  modified_base (261)..(261): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcagtccccgtgagaggccttggagtggctgggaagacattcacgaggtccagatggtattcngtattatgcagtgtctggtgaagagtcgaaatggacatcactacacgacccaaccgaaagaactcgaagtttcctaccctgtacctaagtttcgacctactcgttcggttcaccgtccccggacgacctacggcttacgtctacttattcgtagtaaagacactacccgacgacgggggtactaccacgaccgtaccgtacccccgtacggggaccccgaacgggtaacccgttacgtaccgtaaccccgtccgttacctccgaaccggaccctaccgaacccgaacgggaccccgtaccgtaccggtcccccgttcccccgttccggccccgttcccgccgtaccgtaacccggacggaccgacccgtacccgacccggaacgacggaaccccg

SEQ ID NO: 362071 - DNA, 691 bp, Homo sapiens
  misc_feature: GZ8MTXP02IA7XR.21.86.H09.1.454.CMB.2.raw
  modified_base (159)..(159): a, c, t, g, unknown or other
  modified_base (170)..(170): a, c, t, g, unknown or other
  modified_base (271)..(271): a, c, t, g, unknown or other
  modified_base (304)..(304): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcacgtccccgtgagaggccttgagtggcgtgggaagactattctacgaggtccagtagtggtattctgattangcagtgtctgtagaagtaagtcgaagtggaacntacactacacgacccaacgaagactctagtcctacctgacctattcgactacttcgtcgtcgtacccgtacccggaacgtaaccgccgggttcttaggtacccttaacttagtacgttagtaaacgaccgtaactacccgaacggtacggggacctacccgacgaccgtacccggaccccggtcggggaccggtaaaccgggtaaccctacggtaccctaacccggtccttacccgaccgaccgtaccccgtacccgaaacccggaaacccggtccccgtaaccgttccccgggttaccccttcccccggtaccgggtaccccgtcccgttccgacccgtaaccgacggaccgtacccgaccccgtaccggaacgacccgtacccgg

SEQ ID NO: 362072 - DNA, 734 bp, Homo sapiens
  misc_feature: GZ8MTXP02JK56A.21.86.H09.1.454.CMB.2.raw
  modified_base (275)..(275): a, c, t, g, unknown or other
  modified_base (365)..(365): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagacggccttgagtggcgtaggggaagactattcaacgaggtccagagtggtattcgtgattangctagtgtctggtgaagtaagtcgaaatggactagtaccaactacacgaaccccacgaaagaactcacgttcctacctgacctagtttcncctactctgtccgacctcccggaacgaccgacggtctcgtacttacttacgttgtacgtaaacgtacctaaccgtaccccgaacgggacggggtacccttacccgaaccctacccgtaccccggtacccccggttacgggggaaccccggtaaccgggtaaaccccgttaccggtaacccgtacccggtacccttcccgtaccgaccgtacccccttaacccgaacccggaacccgggtaccccctaccggttacccgggttacccccgttacccccggtaccgggtaccccgtcccccgttccgaccccgttaaccggacccgggaccgttacccccgtacccgaacccgggacgaacccgaccccgg

SEQ ID NO: 362073 - DNA, 574 bp, Homo sapiens
  misc_feature: GZ8MTXP02F8UDF.21.86.H09.1.454.CMB.2.raw
  modified_base (357)..(357): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctcctgcatttgcactctgtgactcccgacgacacggctcgtctactattgtgtaagacnctcccacagggggctccacactccgaccccgtggggccacgggaaccctagtccaccgctcctcacgccctccaccgaacgggcccacgtcgtcccttcccccgtcggcccgccccgtcgccttccgaggacgtccgacccgtccgacgacggcaaccgacggccgcccgtcgggctcggcccgtcggtacgaacggtactaccgttacccgaacgg

SEQ ID NO: 362074 - DNA, 549 bp, Homo sapiens
  misc_feature: GZ8MTXP02FRZIY.21.86.H09.1.454.CMB.2.raw
  modified_base (524)..(524): a, c, t, g, unknown or other
  modified_base (528)..(528): a, c, t, g, unknown or other
tcagtcgtcgctcgcacgaccggtgctcgatttagtgctatagacttgggtttggggggaagaggaagactgacggtccaggactggtgaagccctcgcagacccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacgcggctcgtctactattgtgtaagacatcccacagggggctccacacctcgaccccgtggggcccacgggaaccctagtccaccgtcctcctcacgccctcccaccaacgggccccactccggtcccttcccccgtggcccgcccctcgcctccaggacgccgacctccgagagccacagccgccgtggcngccnggtcaggacctactcccgacg

SEQ ID NO: 362075 - DNA, 652 bp, Homo sapiens
  misc_feature: GZ8MTXP02JE8QA.21.86.H09.1.454.CMB.2.raw
  modified_base (195)..(195): a, c, t, g, unknown or other
  modified_base (298)..(298): a, c, t, g, unknown or other
  modified_base (361)..(361): a, c, t, g, unknown or other
tcagtcgtcgctcgcacgaccggtgctcgatttagtgctatagacttgggtttgggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtgagagcttgagtggctgggaagcattcacaggtccagatggtattctgatttangctagtgtctggtgagaagtcgaaatggacagtcactacacgacccacgaagactcagttccnccgtgactagtttcgactactctgtcgaccgtcccgacgacacggtctagtctacttagttgtagtaacgactactacccgaacggacggggtcctaccgaccgaccgttcccggaacccccggttcgggggaacccaaccggggtaaaccccgtacgtacccgtacccgttaccgtacccgttaccgaccgtaccccgttaacccgaacccggaaacccggggtcccctaacggtttccccggttacccctttacccccggcggtccccgtacccccggtcgtcccccgg

SEQ ID NO: 362076 - DNA, 677 bp, Homo sapiens
  misc_feature: GZ8MTXP02GQO5L.21.86.H09.1.454.CMB.2.raw
  modified_base (241)..(241): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtgagaggccttgagtggctgggaagcattctacnggtccagatggtattctgattatgcagtgtcgtgtgaagagtcgaatggacatcaactacacgacccaacgaagaactcacgtcctcctcgctatttgctactctgtcgacctcccgacgacacgctcgttactacttacttagtacgtaacgactacgtacccaacggacggggccctacccaaccgaccgtacccggaccccggtacgggggaccccgaaaccggggtaaccccttacgggtaccctaacccggtccctacccgttcccaaacccgtccccctaacccgaaaccccggaacccgggtacccccgtaccggtttaccccgggtccccgtttacccccggtccgggtcccccgcccccgttacggtccccgtaaccgtaccggaaccgtacccgaaccccggtacccggacggaaccgaaccccgg

SEQ ID NO: 362077 - DNA, 559 bp, Homo sapiens
  misc_feature: GZ8MTXP02HKWYO.21.86.H09.1.454.CMB.2.raw
  modified_base (159)..(159): a, c, t, g, unknown or other
  modified_base (170)..(170): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctgggaagacattctacaggtccagatggtattctgattatgcagtgtctgtgagaagtcgaaatggacatcaatacagacccacgaagatcagttcctcctgctatttcgctacttcgtgtcgacctcccgacaccacggctgtctactattgtagtaagacagtacccacgacggggcctaccgaccaccgtaccgaccccgtcggggacccgacgggaaccctacgtaccgacccgtcctcctcacgcctaccgaccgacggcccacgtccgtccttccccgtcggccgcccgttcgcctccgacgacgaccgaccgtccgacgacgacccg

SEQ ID NO: 362078 - DNA, 653 bp, Homo sapiens
  misc_feature: GZ8MTXP02HFAZV.21.86.H09.1.454.CMB.2.raw
  modified_base (171)..(171): a, c, t, g, unknown or other
  modified_base (209)..(209): a, c, t, g, unknown or other
  modified_base (277)..(277): a, c, t, g, unknown or other
  modified_base (621)..(621): a, c, t, g, unknown or other
  modified_base (630)..(630): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttancaccactagtacttggaattggatcaggcagtccccgngagaggccttgagtggcgtagggaagacagttcacgacggtccagtagtggttattcgtagatttagngactaggtgtcgtggtagaaggtaacgtacgaaaggtggaactacgtaccaaacgtaaccgaaccgtaaaccccgtaaacgaaagtaaccttacgtacgtttccctccgtacgtacttagtttcgacttacttccgtgtaccggacctacccggacgaccgtacgtctacgttacctacgtttagttcgtaacgtaacactaccgtaccgaacgggtcggtcacccgactccgtacccggacccggtcggaccgtacggtaaccctgtaccctccgtcctccgacgtccgccctaccgaccgtaccgcgtacgtccggtccctcccggcgcccgtccacgtccncgacgaccnccgtaccgacgaccgacacccgg

SEQ ID NO: 362079 - DNA, 530 bp, Homo sapiens
  misc_feature: GZ8MTXP02JZ678.21.86.H09.1.454.CMB.2.raw
  modified_base (159)..(159): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattctacaggtccagatggtatctgattatgcagtgtctgtgagagtcgaatggacatcactacacgacccacgaagaatcagttctcctgctatttgcactctgtcgactcccgagacacggctgtctactattgtagtaagacactcccagacggggctcacacgtccgcccgtgggccgacggacctagaccaccgtctcctcacgcctaccacgaacggcccagtccggtcctcccccgtcgccgcccgtcgcccgtccgacggacgaccgacccgtaccggacgacgaccg

SEQ ID NO: 362080 - DNA, 617 bp, Homo sapiens
  misc_feature: GZ8MTXP02HRPEK.21.86.H09.1.454.CMB.2.raw
  modified_base (168)..(168): a, c, t, g, unknown or other
  modified_base (195)..(195): a, c, t, g, unknown or other
  modified_base (205)..(205): a, c, t, g, unknown or other
  modified_base (304)..(304): a, c, t, g, unknown or other
  modified_base (352)..(352): a, c, t, g, unknown or other
  modified_base (362)..(362): a, c, t, g, unknown or other
  modified_base (367)..(367): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctntcactcacctgcgacatctccgggganagtatcttancaccactagtacttggaattggatcaggcacgtccccgtgagaggccttggagtggctgggaaggcattctacaggtccagtatggtattctgatttangcagtgtctggtgagaagtgaatggacatcactacacgacccacgaanatcacgttcnccctnctatttcgactacgtctgtcgtacctacccggacgacgtacggcttcgtacttacgttattgtagtaaacgactacgtacccgacgggacggggtacctacccgaccgtaccgtacccggaccccggtcggggaacccgaccgggaaccccgtacgtacccgtacccggtcccgtaccctaccgaccgtccctacccaccgtaaccggccctaacgtcccgtcccttccccgcggcccgtccgcgtcccg

SEQ ID NO: 362081 - DNA, 679 bp, Homo sapiens
  misc_feature: GZ8MTXP02F9VF2.21.86.H09.1.454.CMB.2.raw
  modified_base (197)..(197): a, c, t, g, unknown or other
  modified_base (208)..(208): a, c, t, g, unknown or other
  modified_base (304)..(304): a, c, t, g, unknown or other
  modified_base (337)..(337): a, c, t, g, unknown or other
tcagtcgtcgctcgcacgaccggtgctcgatttagtgctatagacttgggtttggggggaagaggaagactgacggtcctgcccgtactgggcctcccatgggggtgtcctgtcgcaaatacagctgcagcagtccggtccaggactggtgaagccctcgcagaccctctcactcacctgcgacatcgtccgggganagtatctttancaccactagtacttggaattggatcgaggcacgtccccgtgagaggccttggagtggcgtgggaagcattcacaggtccagatggtatctgattangctagtgtgtgtagaagagtcgaagtggactancaactacacgaaccccacgaaagtaactcgtacgttcctcccgtgtactacgtttcgcctacttcgtcgtacgtaccgtacccgacgaccgacggtcttacgtaccttagttacgttagtagtaacgtaccaccgtaccgacgggtacggggtaccctacccgaaccgacccgtacccggtaccccggtacggggtacccgtaaccgggtaacccgtacgtacccgtacccgttccgtcccgtaccgtacccgtaccccgtacccgaacccggtacccggaccccgtaaccggtttcccggtcccccgttcccccggtcggtcccgtcccgtcggtaccccg

SEQ ID NO: 362082 - DNA, 634 bp, Homo sapiens
  misc_feature: GZ8MTXP02G5M9Y.21.86.H09.1.454.CMB.2.raw
  modified_base (159)..(159): a, c, t, g, unknown or other
  modified_base (258)..(258): a, c, t, g, unknown or other
  modified_base (321)..(321): a, c, t, g, unknown or other
  modified_base (366)..(366): a, c, t, g, unknown or other
  modified_base (382)..(382): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattcngattatgcagtgtctgtgagaagtcgaatggacatcactacagacccacgaagactcagttcncctgctatttcgctactctgtcgacctcccgacgaccaccgggtntacgttaccttacttnttagtagtaacgactacgtcccacggtacggggcctacccgactaccgtccgtaccccggtcgggacccgacgggtaaccccgttacgtaccctaacccgtctacccgtacctaccgaccctacccgtaaccccgaaccggtaccccggtacccgttaccggttccccgttacccccgttcccggtcccgtccccgtccgtcccgtaacccgtaccggaccgacccgtcccgacccggtacggaccgacccg

SEQ ID NO: 362083 - DNA, 784 bp, Homo sapiens
  misc_feature: GZ8MTXP02JM5ZZ.21.86.H09.1.454.CMB.2.raw
  modified_base (160)..(160): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcgaggcacgtccccgtcgagaggccttgagtggcgtgggaagactattctacgaggtccagtatcgtattctgtattatgctagtgtactgtgaagtaacgtcgaagttcggaactatacctaactacgaacgaaccccaaccggaaagaactccgtacgttcctcctagacttagtttacgcctactcgtgtcgtacccgtcccgaacgaccgacggtcttcgttaacttacgttagttacggttaacggtaaactaccgtaccgtacccgaaccgggtaccgggggtaccccttacccgaaccgtaaccccgttacccccgggtaacccccgggttaccgggggaccccggtaaaacccggggtaacccccgttaccggtaaccccgtacccccggttaccctcccccggttacccgacccggttacccccgtaaccccgtaaacccggtaaaccccgggggaccccttacccgggttaccccggtttacccccgttcccccgggtccggtacccccgtccccgttccgaccccgtcccgaaccgggacccgtaccccgaaccggtccccgaaacggtccgaacccg

SEQ ID NO: 362084 - DNA, 617 bp, Homo sapiens
  misc_feature: GZ8MTXP02FLYC5.21.86.H09.1.454.CMB.2.raw
  modified_base (160)..(160): a, c, t, g, unknown or other
  modified_base (256)..(256): a, c, t, g, unknown or other
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttatcaccactagtacttggaattggatcaggcagtccccgtcgagaggccttgagtggctgggaagacattcacaggtccagatggtnttctgattangcagtgtctgtgaagtaagtcgaatggacatcaactacaacgacccaaccgaagaactctaacgttcctccctgtctatttgacctacttcgttgtcgaccctcccggtaacgaccgcggtcttcgtacttacttagttgtagtaaacgactacgtacccacggacggggcctaccgaccaccgtacccgaccccggtcggggacccgaaccgggtaacccgtacgtacccgtacccgtcctaccctccgtaccgccctacccgaccgaaccggccctacgtccgttcccctccccgtcggcccgtccctcgaccgtccgacggacgacccaccgtaccggacgacacccg

SEQ ID NO: 362085 - DNA, 567 bp, Homo sapiens
  misc_feature: GZ8MTXP02GJB2X.21.86.H09.1.454.CMB.2.raw
  modified_base (159)..(159): a, c, t, g, unknown or other
  modified_base (264)..(264): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcagtccccgtgagaggccttgagtggctgggaagacattcacaggtccagatggtattctgattangcagtgtctgtgagaagtcgaatggacatcactacacgacccacgaagatcagttcctcctgctatttgctactctgtcgacctcccggacgaccacggctgtactactattgtagtaacgacactcccgacgacggggcctaccgaccacctaccggaccccgtcggggcccgaacgggaccctacgaccgacccgtctcctcacgccctaccgaccgacggccctacgtcccggtcccttcccccgcggcccgtccctcgcccgtccgacggaccgccgtacccgaccgacggacgacccg

SEQ ID NO: 362086 - DNA, 572 bp, Homo sapiens
  misc_feature: GZ8MTXP02I2GFM.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagtaagtcgaaatggacatacactacacgaccccaccgaagaaactcagttcctccctgctatttcgacctactccttgtcgacctcccgacgacacggctgtctactattgtagtaagacactcccacgacggggctccacacgtccgaccccgtcggggaccgacggaaccctacgtaccacccgtccgtcctccacgccctacccaccgaccggaccctacgtcccggtcccgttcccccgtcggcccgtccctcgcctccgacggacgccacccgtccgacgacgaccg

SEQ ID NO: 362087 - DNA, 661 bp, Homo sapiens
  misc_feature: GZ8MTXP02JKPV2.21.86.H09.1.454.CMB.2.raw
  modified_base (159)..(159): a, c, t, g, unknown or other
  modified_base (170)..(170): a, c, t, g, unknown or other
  modified_base (269)..(269): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtcccgtgagaggccttgagtggctgggaagcattcagaggtccagtatggtattcttatatgctagtntctgtagagaagttcgaaatggaacagtaccaacgtaacacggaacccctaacggaaagacttacgtacgttcctaccctggacctatttcgacctaacttctaggttacaccgttcccgaagtaccgtaccgggcttcgtaccttaacttagttacgtagttaaacgactacgtacccgtacggaccgggggtcctaccgtaccgaccgtcccggaccccggtcggggacccgaccgggtaacccgtacgtacccgtaaccgtcctaccgtaccaccgccctaccgaccgaaccggccctacgtcccggtcccttccccggtcggcccgtccccgtacgcccgtaccgaacggaccgacccgtacccgtaccgaacgaccgaccgaaccgg

SEQ ID NO: 362088 - DNA, 534 bp, Homo sapiens
  misc_feature: GZ8MTXP02F8DED.21.86.H09.1.454.CMB.2.raw
  modified_base (356)..(356): a, c, t, g, unknown or other
  modified_base (475)..(475): a, c, t, g, unknown or other
  modified_base (497)..(497): a, c, t, g, unknown or other
  modified_base (510)..(510): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccacgaagaatcagtctcctgcatttgcactctgtgactcccgacgacacggctcgtctactattcgtgtaagacntcccacgagggggctccacactcgaccccgtgggcccgagggaaccctagtccaccgtctcctcacgccctccaccagggcccactccggtccttccccctggccgccctcgcctccgnggacgcacctccgagacgcacncgccgccctggcngcctggtcaaggctacgtccgacg

SEQ ID NO: 362089 - DNA, 637 bp, Homo sapiens
  misc_feature: GZ8MTXP02H6A1K.21.86.H09.1.454.CMB.2.raw
  modified_base (160)..(160): a, c, t, g, unknown or other
  modified_base (171)..(171): a, c, t, g, unknown or other
  modified_base (258)..(258): a, c, t, g, unknown or other
  modified_base (265)..(265): a, c, t, g, unknown or other
  modified_base (323)..(323): a, c, t, g, unknown or other
  modified_base (351)..(351): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccgggganagtatctttancaccactagtacttggaattggatcaggcagtccccgtgagaggccttgagtggctgggaagacattcacaggtcagatggtattcngattagngctgtgtgtgtagaagtagtacgtaagtgacatacaactacgacgaacccaaacgaanactactacgttcctcctgacttagttcnctactcgtcgtcgtacccgtaccgaacgtaccgtacgtctactactacttagtagtacgtaacgacacgtaccgacggacgggtacctaccgtaccgtaccgtacccggtacccggtaccgggaccgtaacggtaacccgtacgtaccgtaccgtcctaccgtaccgaccgtacccgtacccgaacccggaacccggtaccctaccggttcccgtaccccgtccccggtccggcccgtcccgtccgccgaaccgacgaccgtaccctaccgtaccgacgacgaccg

SEQ ID NO: 362090 - DNA, 604 bp, Homo sapiens
  misc_feature: GZ8MTXP02FZRIO.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcacgtccccgtgagaggccttgagtggctgggaaggacattctacaggtccagagtggttattctagtattatgactagtgtctggtgagtaagtcgaaagtggacatacactacacgaaccccacgaagaatcagttcctacctgtacctattcgctactctgttcgacctcccgacgaccgacggtcttgtactactattcgtagtaacactactaccgacgacggggtctacgacctacgtaccgacgtcccggacgggtaccgtaacggtaccccgtaacgtccctaccgtccctccgtacaccccgccgtacccgaaccgtaaccggcctacgtcccgtcccgttccccgtccggtccgtcccgtcgaacccgtccgacggacgaccaccgtacgacgacg

SEQ ID NO: 362091 - DNA, 595 bp, Homo sapiens
  misc_feature: GZ8MTXP02FI2TK.21.86.H09.1.454.CMB.2.raw
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcacgtccccgtgagaggccttgagtggctgggaagcattctacaggtccagatggtatctgatatgcagtgtctgtgagtaagtcgaatggacatcactacacgaccccacgaagaactcagttcctacctgacctatttcgctactctggtcacctcccgagaccagtctgtctactattgtagtaagacactacccgacgacggggactaccgacctaccgtacccgacccccgtcggggacccgaacgggtaacccctacggtacccacccgtacctacccgtaccgtacgccctacccgacccgaaccggcccctacgtcccggttccccttccccgtccggcccgtcccgtcgtcccgtccgacggaccgccacccgtaccgacgacgaccg

SEQ ID NO: 362092 - DNA, 611 bp, Homo sapiens
  misc_feature: GZ8MTXP02H56QU.21.86.H09.1.454.CMB.2.raw
  modified_base (170)..(170): a, c, t, g, unknown or other
  modified_base (264)..(264): a, c, t, g, unknown or other
  modified_base (342)..(342): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttancaccactagtacttggaattggatcaggcagtccccgtgagaggccttgagtggctgggaagacatctacaggtccagatggtattctgattangcagtgtctgtgagaagtcgaaatggacatcactaacagacccaacgaagaactcacgtctcctgctatttgctactntgtcgacctccgacgacacggctgtctactatgtataagacactacccgacgacggggcctaccgacaccgtacccggacccccggttacgggggacccgtaaaccggggtaaccccttacggtacccgtaaccccggttcctacccgttcaaccgtcccctacccgaaacccgaaccggggacccctacgtcccggttcccttacccccggtcggcccgtccctcgccgtcccgacggaccgaccgtacccgtcccgacgaaccgccg

SEQ ID NO: 362093 - DNA, 652 bp, Homo sapiens
  misc_feature: GZ8MTXP02H2KWU.21.86.H09.1.454.CMB.2.raw
  modified_base (325)..(325): a, c, t, g, unknown or other
  modified_base (343)..(343): a, c, t, g, unknown or other
  modified_base (346)..(346): a, c, t, g, unknown or other
  modified_base (359)..(359): a, c, t, g, unknown or other
  modified_base (366)..(366): a, c, t, g, unknown or other
  modified_base (372)..(372): a, c, t, g, unknown or other
  modified_base (422)..(422): a, c, t, g, unknown or other
  modified_base (625)..(625): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagacggccttgagtggcgtggggaaggactagttctacgacggttacccaggtagttcggttaatttcgtagtattaagtgactaggtgtcgtgtagagagtcgaagtggacancactacacgacccagaanacncgtacgtcctccngctattnctactntgcaccgtccgacgacgtacgtctgttactactagttgtaacgtacgacncctaccgacggacggtaccctacaccgtaccgtccccggtacccggtcgggacgtaaccgtaacccgtacgtcccgtaccgtccctacccgtcgaccgtacccctaccgaaaccccgaccgggacccctaccggtttccccggttaccccttacccccgggcggtcccccgtcccgttaacggccctaaaccggcggaacccncccgaccccgtacggaccgacgacccg

SEQ ID NO: 362094 - DNA, 679 bp, Homo sapiens
  misc_feature: GZ8MTXP02GP61Y.21.86.H09.1.454.CMB.2.raw
  modified_base (279)..(279): a, c, t, g, unknown or other
  modified_base (315)..(315): a, c, t, g, unknown or other
  modified_base (329)..(329): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcgaggcagtccccgtgagagccttgagtgctgggaagcattcacaggtccagtagtggtattctgagttatgcagtgtactggtnagaagtcgaatggacatcactacacgacccacgaanaatcagttcctccngccatttgacctatcgtgtcgactcccggacgacgtaccggcttacgtacctacctagtttgtagtaaacgtaaccgtacgttaccccgaacggacgggggtacccttacccgaaaccgtacccggttacccgaaacccccgggttcgggggaccccgaaacgggggaacccccttacgggtaccgtaaaccccggtaccttccccgtacctaaccggccccttacccgtaacccgaaaccggtccccgaacgttcccggttcccgtttccccccgcggtccccgtccccgttacgcccggttaaccgaaccggccggtacccgaacccgtccggaccgacgaaccccgg

SEQ ID NO: 362095 - DNA, 648 bp, Homo sapiens
  misc_feature: GZ8MTXP02FGAKO.21.86.H09.1.454.CMB.2.raw
  modified_base (196)..(196): a, c, t, g, unknown or other
  modified_base (208)..(208): a, c, t, g, unknown or other
  modified_base (282)..(282): a, c, t, g, unknown or other
  modified_base (308)..(308): a, c, t, g, unknown or other
  modified_base (317)..(317): a, c, t, g, unknown or other
tcagtcgtcgctcgcacgaccggtgctcgatttagtgctatagacttgggtttgggggaagaggaagactgacggtcctgcccgtactgggcctcccatgggggtgtcctgtcgcaaatacagctgcagcagtccggtccaggactggtgaagcccctgcagaccctctcactcacctgcgacatccgtccggganagttatctttancaccatagtacttggaattggatcgaggcacgtccccgtgagaggtccttggagtggctggggaagcaattcanaggtccagatggtattctgatttagngctagtgtntggagaagtaagtacgaagtggactataccaacctaaccaacccgaaccccaaacgaaataactcgtacgttcctcctgactatttcactactctgtcgaccgtacccgacgacgacgtctcgtactacttagttacgtagtaacgacaccgtacccgacggtacgggtaccacccgtaccgtacccgtacccggtaccccggtacgggacccgaaccggtacccgtacgtacccgtacccgtcctccctaccgaccgaccctacccgaacccgaacccggcccgtaaccgttcccggttccccgttccccgtccgcccgcccgtcgtccg

SEQ ID NO: 362096 - DNA, 724 bp, Homo sapiens
  misc_feature: GZ8MTXP02FGC57.21.86.H09.1.454.CMB.2.raw
  modified_base (258)..(258): a, c, t, g, unknown or other
  modified_base (296)..(296): a, c, t, g, unknown or other
  modified_base (355)..(355): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaacgccctcgcagaccctctcactcacctgcgacatcgtccggggagagtatctttatcaccactagtacttggaattggatcagcagtcccgtgagaggccttgagtggctggggaagacattcacaggtccagatggtatcngtattatgacagtgtctgtagagaagtcgaatggactntcactacacgaacccacgaagaactcgagttcctcctagtcctattgcctatcctgtcncctacccgacgacacgtctcgtacttacttattgtagtaacgactacgtaccccgacggacggggacctccgaaccgaccgtaccccggtacccccggtcgggggaaccccgaaccggggtaaaccccgttaccgggtacccgtaaccccggttcccttaccccgtaccgtaccgtacccccgtaaccccgaaacccgggaaaaccccggggtccccctaaacccgggtttaccccggtttccccccgtttaccccccggtacccgggtcccccggttaacccccgccggttaaccccgtccccggtaaaaccggggtaacccgaccccgtaaccccgttaacccgggaaaccggccggtaaaccccgg

SEQ ID NO: 362097 - DNA, 585 bp, Homo sapiens
  misc_feature: GZ8MTXP02IGSSB.21.86.H09.1.454.CMB.2.raw
  modified_base (159)..(159): a, c, t, g, unknown or other
  modified_base (170)..(170): a, c, t, g, unknown or other
  modified_base (315)..(315): a, c, t, g, unknown or other
  modified_base (349)..(349): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggcttgagtggctgggaagctattctacaggtccagtatggtattctgattatgcagtgtctgtcgagaagtcgaatggacagtcatacacgtacccacgaanactcagttctacctgactatttcgctacttcgtntcggacctcccgaacgtacgacggtctgtactacttatcgtagtaacgacactaccgacgacggggctaccgacaccgtccgaccccggtacgggacccgtaacgggaaccctacgggtaccctaccggtacctccgtcaccgtcctacccaacgaccggaccctacggtcccggtccctttccccgcggcccgcccgttcgccgtccgacgacgacctaccgccgacgacgaccg

SEQ ID NO: 362098 - DNA, 766 bp, Homo sapiens
  misc_feature: GZ8MTXP02JDEQW.21.86.H09.1.454.CMB.2.raw
  modified_base (133)..(133): a, c, t, g, unknown or other
tcagtcgtcgctcgcacgaccggtgctcgatttagtgctatagacttgggtttgggggaagaggaagactgacggtccaggactggtgaagccctcgcagaccctctcactcacctgcgacatctccgggganagtatctttatcaccactagtacttggaattggatcaggcagtccccgtgagaggccttgagtggctgggaagcattctacaggtccagatggtattctgattatgctagtgtctgtgagaagtcgaatggacatcactacagacccaacgaagaatcagttctcctgctattgcactctgtcgtactcccgacgacgcgctcgtctactattgtagtaagacactccctacggacgggggcctacccgacgaccgttacccggacccccgtcgggggaccccaacggggaaccccctacggttacccaacccggttcctaccccgttaccgaaccggacccccttaccccgaacccgaaacccggggtaccccctaacgttccccgggttcccctttacccccccggtccgggtacccccggcccccgtttcggggaccccccttcccggaaaccgggtaccggacccgtaacccccgtacccgggtaaacggacccggtacccggaaacccggaaaccggggccccgggtacccccggttccgggggccctaacccggggtccccggttacgggtacccggtaaaacgggtacccccgtttaaccggtttacccccggtaaaccccggggg

SEQ ID NO: 362099 - DNA, 702 bp, Homo sapiens
  misc_feature: GZ8MTXP02JPJ0R.21.86.H09.1.454.CMB.2.raw
  modified_base (159)..(159): a, c, t, g, unknown or other
  modified_base (170)..(170): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctgcagaccctctcactcacctgcgacatcgtccgggganagtatctttancaccactagtacttggaattggatcaggcagtccccgtgagaggccttgagtggctggggaagcattcacaggtccagtatggtattctagattagtgctagtgtactggtgaacggaagttcgaaatggacagtaccaactacgaagaccccaaacggaaagaactacgtacgtacctccctagcctatttcgactacgtcttgtccgtaccgtcccggaacggtacccacggggttccgttatccttaaacgttatttacggttaacgtaaacgtaacctaacgttaccccgaacgggacgggggacccttacccgaaaccgtccgttacccccgggaccccggttacgggggaccccgtaaaacgggggaccccttacggtaaccgtaacccggttcctacccgttaccgaccgttaccaccgttaacgaaacccgggtccctacggttcccggttccttcccccggtcggtaccccgcccgtttacgccgttccgacggaaccgtccgacctccggaacgacgaaccg

SEQ ID NO: 362100 - DNA, 609 bp, Homo sapiens
  misc_feature: GZ8MTXP02HN3QI.21.86.H09.1.454.CMB.2.raw
  modified_base (160)..(160): a, c, t, g, unknown or other
  modified_base (171)..(171): a, c, t, g, unknown or other
  modified_base (240)..(240): a, c, t, g, unknown or other
  modified_base (263)..(263): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatctccgggganagtatctttancaccactagtacttggaattggatcaggcagtccccgtgagaggccttgagtggctgggaagcattcanaggtccagatggtatctgattangcagtgtctgtagagaagtcgaatggacatcactacacgacccacgaagatcagttctcctgcctatttcgctactctgtcgacctccgaacgtaccgacggtctagttctacttagttacgtagtaacgacactacccgacgacggggtctaccgacaccgtccggacccgtcggggaccgtaacgggtaaccctacgtacccgtacccgtcctccctccgacgaccctacccgaccgaaccgggtacccctacggttacccggttcccgttcccccgtccggtcccgaccccgttccggcccgtaacccgacggaccgaccgaccccgaccgaccgacgacccg

SEQ ID NO: 362101 - DNA, 674 bp, Homo sapiens
  misc_feature: GZ8MTXP02F304P.21.86.H09.1.454.CMB.2.raw
  modified_base (196)..(196): a, c, t, g, unknown or other
  modified_base (394)..(394): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttatcaccactagtacttggaattggatcaggcacgtccccgtgagaggccttgagtggcgtgggaaggcattctacaggtccagatggtattcgtgattatgctagtgtctgagagaagtcgaagtggacatcaactacaccgaccccaacgaaagtaactcgtacgttcctccctgacttaggtttacnccttaacgttcgtgtcgtacccgtacccgaaccgacgaccggtcttcgtaccttacttagttagtagtaacgtaacctacgtacccgacggacggggtcctacccgacgtacccgtcccggaccccggtacggggacccgacgggtaaccccgtacgtacccgtaaccgttccttacccgtccgtacccgtacccgtaccccgaacccggaacccgggtaccccaaccgttcccggttacccgttcccccggtccggtcccgtccccgtccgtaccccgg

SEQ ID NO: 362102 - DNA, 736 bp, Homo sapiens
  misc_feature: GZ8MTXP02G7MW5.21.86.H09.1.454.CMB.2.raw
  modified_base (274)..(274): a, c, t, g, unknown or other
  modified_base (424)..(424): a, c, t, g, unknown or other
  modified_base (559)..(559): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcgaggccacgtccccgtgagacggccttgagtggcgtgggaagactatctacaggtccagagtggtattcgtgtattancggctagtgtcgtaggtgaagtaaggtcgaaagtggaacagtaccaactaacgaaccgtaacccccaacgtaaagaacttaccgtacgttccctcccgtgtacttatttacgacctacttgtcgtcgacctaccgacgtaacgtccggtntacgtacttacgtagttacggtagtaacgactaaccgtacccgacgggaacgggtccctaacccgaccgtacccggtaccccggaccccggttacgggggacccctaaaccgggtaaccccgtacggtaaccccncccggttacccctacccgtaccgaccggtccccctaacccgtaacccggaacccggttacccgtaccggtttcccgtcccccgttacccccggttcggccccgtcccccgtacggtacccgtaacccggaacggaccccggacccgtaccccggaccggaccggaaaccgacccggg

SEQ ID NO: 362103 - DNA, 727 bp, Homo sapiens
  misc_feature: GZ8MTXP02IG2UM.21.86.H09.1.454.CMB.2.raw
  modified_base (269)..(269): a, c, t, g, unknown or other
  modified_base (322)..(322): a, c, t, g, unknown or other
  modified_base (334)..(334): a, c, t, g, unknown or other
  modified_base (345)..(345): a, c, t, g, unknown or other
tcagtcgtcgctcgcacgaccggtgctcgatttagtgctatagacttgggtttgggagatcatgagggtgtcctgtcgcaaaatacagctgcagcagtccggtccaggactggtgaagcccctcgcagaccctctcactcacctgcgacatctccggggagagtatctttatcaccactagtacttggaattggatcaggcagtccccgtgagaggccttgagtggctgggaagcattctacgaggtccagtatggtattctgtattangcagtcgtctgtgagtaagtcgaatggacatacactacgacgaacccacgaanactcacgttccncctgctattcnctatctgtcgacctcccgagaccacgtctcgttactacgttattgtacgtaacgactacgtacccgacgggacggggtccctacccgacctacccggtacccggtacccccgggttacggggaccccggtaaccggggtaaacccccttacggtacccccgtaaccccggttcccttaccccgtacccgtacccggtacccccgtaccccgaaaaccccggtaacccgggtaacccccgttcggttacccccgggtttcccccgtttaccccccggtaccggggtcccccgttacccccgtccggttaccccgtaaccccggtaacgggtaacccgcccccgtaaacccccggttacccggaacggacccggtaacccccgg

SEQ ID NO: 362104 - DNA, 620 bp, Homo sapiens
  misc_feature: GZ8MTXP02G9MYM.21.86.H09.1.454.CMB.2.raw
  modified_base (193)..(193): a, c, t, g, unknown or other
  modified_base (204)..(204): a, c, t, g, unknown or other
  modified_base (274)..(274): a, c, t, g, unknown or other
  modified_base (298)..(298): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtcaggactggtgaagccctgcagaccctctcactcacctgcgacatctccgggganagtatctttancacactagtacttggaattggatcaggcagtccccgtgagaggccttggagtggctgggaagcatcaacnggtccagatggtattctgatttangctagtgtctgtagaagaagtcgaaatggaacagtcaactacacgaaccccaacgaagaactcagttcctccctgctatttgactactctgtacgacctcccgaacgacgtacggtctcgtactacgtattacgtagtaacgacactacccgacggacggggcctaccgaacaccgtaccgaccccggtcggggacccgtaaccgggaaccctacgtaccgtaccggtcctcccgtaccaccgtccccgtaccgaacccgaaccgggaccctaacgttcccggtaccccgtttccccgaccggtcccgtcccgtacgtcccg

SEQ ID NO: 362105 - DNA, 603 bp, Homo sapiens
  misc_feature: GZ8MTXP02HW0X7.21.86.H09.1.454.CMB.2.raw
  modified_base (159)..(159): a, c, t, g, unknown or other
  modified_base (170)..(170): a, c, t, g, unknown or other
  modified_base (259)..(259): a, c, t, g, unknown or other
  modified_base (265)..(265): a, c, t, g, unknown or other
  modified_base (316)..(316): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttancaccactagtacttggaattggatcaggcagtccccgtgagaggccttgagtggctagggaagacattcacaggtccagatggtattcngattangcagtgtctgtgagaagtcgaatggacatcaactacacgaccccaacgaanaatcagttctccctgacctatttcgactatctgtcgacctcccgacgaccaacgggtctagttctaactattgtagtaagacaactcccgacgacggggacctaccacacctaccgaccccgtaggggacccgacgggaacccttaggtacccaaccgtcctaccgtaccacgccctacccaaccgaaccgggtcccacgttccggttcccttaccccgtcggtacccgtccccgtcgtaccctaaccgacggaccgaccgacccgtacccgaacgaacccaaccgg

SEQ ID NO: 362106 - DNA, 657 bp, Homo sapiens
  misc_feature: GZ8MTXP02I8I7R.21.86.H09.1.454.CMB.2.raw
  modified_base (260)..(260): a, c, t, g, unknown or other
  modified_base (266)..(266): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcacactagtacttggaattggatcgaggcagtccccgtgagagccttgagtggcgtgggaagcattctacgaggtccagatggtattcngattangcagtgtctgtgagtagtcgaagtggacatcaacacacgaccccaacgaagtactcgtattcctacctgacttagttcgctacgttcctggttccgacccttaccccggaacaccgacgtctacgttacctacgttacttaggtacgtaacgtaacgtacctacccgaacgtacggggcctacccgacacccgtacccggaccccgtacggggacccgtaaccggtacccgtacggtacccgacccggttacctcccgtcgaaccgtccccaccgaccggaacccggtcccgtaccgttcccgttccccgttacccgaccggtcccgtcccgttaccggtacccgaaccgtacggaccggtaccctacccgtccgaccggacgaaccccgg

SEQ ID NO: 362107 - DNA, 580 bp, Homo sapiens
  misc_feature: GZ8MTXP02FL74E.21.86.H09.1.454.CMB.2.raw
  modified_base (374)..(374): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatcgtccggggagagtatctttatcaccactagtacttggaattggatcaggcagtccccgtgagaggccttgagtggctgggaaggcattcacacggtccagatggtattctagattatgcagtgtctggtagagaagtcgaagtggacatcaactacgacgacccaacgaagactcagttcctcctgactatttcgactacgttctgtcaccgtcccgacgacncgctgtctactattgtagaacgacactccgacgcgggctacacacctccgaccgcgggaccgacggacctacgtacctacccgtctaccgtcaccgccctaccgaccgaaccggccctacgtcccggtccccgttcccccgtcggccccgtccctccggtacctcccgacggtaccgaccgtacccgaccggacgaccgaacccgg

SEQ ID NO: 362108 - DNA, 777 bp, Homo sapiens
  misc_feature: GZ8MTXP02IQ1X0.21.86.H09.1.454.CMB.2.raw
  modified_base (196)..(196): a, c, t, g, unknown or other
  modified_base (207)..(207): a, c, t, g, unknown or other
  modified_base (305)..(305): a, c, t, g, unknown or other
  modified_base (333)..(333): a, c, t, g, unknown or other
  modified_base (356)..(356): a, c, t, g, unknown or other
tcagtcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatcgtccgggganagtatctttancaccactagtacttggaattggatcaggcacgtccccgtgagaggccttgagtggcgtaggaaggacattcacaggtccagatggtattctagattangctagtgtctgtgaagagtcgaagtganatcaactacacgaccccacgaanactctacgttcctccctgacctatttcgcctcgttactcgtaccgtcccgtacccggtacgaccgtaccggttaccttcggttaacttaccgtttaagttacggtaacgttaaacgaacctaaccgttacccgaacggggttacgggggtcccctaacccgaaccccgtaccgtacccccggtaacccccggggtacggggaaaccccggtaaaccggggtaaacccccgttacggtaccccgttaccccggttacccgttaccccgtaccgtaaccccggtacccccttaacccccggaaaaccccgggtaaccccggtaacccccggttaacccggtttccccccggggtttaccccccgtttacccccccggggtaccgggtcccccggttcccccggtttaaccggtacccccccgg

SEQ ID NO: 362109 - DNA, 671 bp, Homo sapiens
  misc_feature: GZ8MTXP02JSKA8.21.86.H09.1.454.CMB.2.raw
  modified_base (161)..(161): a, c, t, g, unknown or other
  modified_base (172)..(172): a, c, t, g, unknown or other
  modified_base (242)..(242): a, c, t, g, unknown or other
  modified_base (258)..(258): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagacccctctcactcacctgcgacatctccgggganagtatctttancaccatagtacttggaattggatcaggcacgtccccgtgagaggccttgagtggctggggaagcattcanaggtccagatggtatntgattatgctagtgtctgtgaagaagtcgaatggacatcaactacacgaccccaacggaataactctacgttcctccgtcgtactactttgacctacttcgtgtcgacccgtcccgacgacacggtcttgtactactagtttgtagtaacgtactacgtacccgacggacggggcctacccgaccgtaccgtcccggaccccgtcgggggaccctacgggtaccgtaaccccgtaacgtcccgtacccgtaccctttcccgccgtaaccgtccccgtaccccgaaacccggtaaaccggggtccccctaaaccggttccccggggttaccccttaccccccggtcggtccccgtccccgttacggcccgtacccggaacggacccgaccctacccggtaccggaacgacccgg

SEQ ID NO: 362110 - DNA, 674 bp, Homo sapiens
  misc_feature: GZ8MTXP02JUHJX.21.86.H09.1.454.CMB.2.raw
  modified_base (162)..(162): a, c, t, g, unknown or other
  modified_base (173)..(173): a, c, t, g, unknown or other
  modified_base (251)..(251): a, c, t, g, unknown or other
  modified_base (314)..(314): a, c, t, g, unknown or other
  modified_base (326)..(326): a, c, t, g, unknown or other
  modified_base (340)..(340): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagcccctcgcagacccctctcactcacctgcgacatcgtccgggganagtatctttancaccactagtacttggaattggatcaggcagtccccgtgagagccttgagtggctagggaagacattcagaggtcagntggtattctgattatgctagtgtctgtgagaagtcgaatgacatcactacacgacccacgaanatcagtcctccngctattgctactcngtcgacctccggactacgacgtctgtacctacttacgttagtagtaacgtacacgtacccgacggacgggggacctcccgaccgaccgtacccggtaccccggtacggggaccccggaaccgggtaaccccgtacgggtacccgtaacccggtcctacccgtaccgtaccggtacccctacccgaaacccgaaccgggtaccccctaccggttacccggtccccgtttacccccggtccgggtccccgtaccccgttcccggaccccgttaacccggaaccgggtacccggtaaccccgtaccccggtacccggaacggtaccggaacccccgg

SEQ ID NO: 362111 - DNA, 715 bp, Homo sapiens
  misc_feature: GZ8MTXP02GIIYK.21.86.H09.1.454.CMB.2.raw
  modified_base (265)..(265): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatcgtccggggagagtatctttatcaccactagtacttggaattggatcaggcacgtccccgtgagacggccttgaggtggcgtggggaagacattcacgaggtccagatggtattcngtattatgcagtgtacgtgtagaagaagtacgaaagtggactaataccaactaaccgaacgaaccccaaacgaaagtaaactcgtaacgttcctcccgtagactagtttacgcctacttcgttacgtcggacccctacccggtaacgtaaaccgccgggtctacgttaccttaacttattaggtagtaaacgtaacaacttacccgaacggaacgggggtccctaccgaaccgtacccgtacccggaccccggtacggggaccgtaaccgggtaaacccgttaccggtaccgtaccccgttcctacccgtactaccgtccccgtacccgaaccgaaccgggtaccctacccggttccgttaccccgttcccccgtcgggccccgtccccgtcgacccgtaaccgaaccggaccgtacccggtaacccgtaccggaacggaccgaacccgg

SEQ ID NO: 362112 - DNA, 642 bp, Homo sapiens
  misc_feature: GZ8MTXP02JG8MH.21.86.H09.1.454.CMB.2.raw
  modified_base (159)..(159): a, c, t, g, unknown or other
  modified_base (386)..(386): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccgggganagtatctttatcaccactagtacttggaattggatcaggcacgtccccgtgagacggccttgagtggctgggaagactattcacaggtccagatggtattctgattatgcagtgtctgtgaagtaagtcgaatggacatcgactacagaccccagaagtactcagttcctcctgacctatttcgctacttctgtcacctcccggacaccgacgtctcgtacttactnttagagtaacgactactacccgacggtacggggtactcccactaccgtaccggtaacccccgtgggggacccgtacggggaaaccccttcggtacccgtacccgtccgtacccgtccaaccgtccctacccgacccgaaaccgggccccttaaccgtcccggttccccgttccccccgtcgggtccccgtcccccgttcggcccctaaccggtacggacccgtaccgaccccgttaccggaacgaaccgtaccccg

SEQ ID NO: 362113 - DNA, 727 bp, Homo sapiens
  misc_feature: GZ8MTXP02HJS6S.21.86.H09.1.454.CMB.2.raw
  modified_base (160)..(160): a, c, t, g, unknown or other
  modified_base (171)..(171): a, c, t, g, unknown or other
  modified_base (209)..(209): a, c, t, g, unknown or other
  modified_base (259)..(259): a, c, t, g, unknown or other
  modified_base (265)..(265): a, c, t, g, unknown or other
  modified_base (301)..(301): a, c, t, g, unknown or other
tcagtcgtcgctcgcacgaccggtgctcgatttagtgctatagacttgggtttgggagatcatgagggtgtcctgtcgcaaatacagctgcagcagtccggtccaggactggtgaagccctcgcagacccctctcactcacctgcgacatctccgggganagtatctttancaccactagtacttggaattggatcaggcagtccccgngagaggccttgagtggctgggaagctattcacaggtccagatggtattcngattangcagtgtctggtgagaagtcgaatggacatcactanacggacccctaacggaaagtaactcaacgtttccacccttgcctagtttgacctacgttccgtggtacgacccgttacccggaacgaacctaccggggtccttaggttaccttaacttacgttacggtacgtaaacgtaccaactacccgtaccggaacgggggtccctacccgaacccgtaaccgtcccggtaaccccgtacgggggaccccgtaaacggggtaaacccccgttaccggttaccgtaaccccgggttcccttaccccgtaccgtaaccgtccccgttaaccccgaacccgtaaaaccggggaccccctaaccggttacccggttcccccgtttcccccgtaccgggcccggtacccccgtccgtcccgttaaccgacgggtaccacccgaacccggtacccgacggaccgaaccg

SEQ ID NO: 362114 - DNA, 569 bp, Homo sapiens
  misc_feature: GZ8MTXP01DHG64.45.39.D06.1.454.CMB.2.raw
  modified_base (302)..(302): a, c, t, g, unknown or other
  modified_base (520)..(520): a, c, t, g, unknown or other
  modified_base (524)..(524): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagagtgtccagtgtcaggtggaagtggtgcaggtccgggggagcgtggtccagccgtgggacgtccctgacactctcctgtgagcgcctggactcacctcagtggctatggccttcactgggtccnccaggtccaggcaagggggctggagtggttggctgatatagtggtatgagtggagaagaactaacactttgctagactcggtagacggggccagttcacatcgacccgagacgaactaacttaccaaggaaacactaattaggttactacgttacgggactaaagtacgaaacaacctaggacgacccgaaggacgacgggtaatattattcttgcgngagngaggtgggggttctcgttggttcgggttactttccgttgttcggg

SEQ ID NO: 362115 - DNA, 855 bp, Homo sapiens
  misc_feature: GZ8MTXP01EAPPR.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgctggactcaccttcagtggctagtcggccctttcacgttcggggtcccgccgtaaggggtttccccaaggggaccgtaaaggggggggtccttagggggtaacggtttgggggttttacgggccgtttaggaaagtttaagtttaaacggttgggggttaaattacgggtaaagttagggggaaaaaacgtaaacggtaaacccgttaaaaaacgtaccgtttttacggaccgtaaacgggtaacccgttcccggggtagggaacggggggtacccgtaacgtttacccgaaccctaacgttacccggaaccccgaaagggtaaacggaaacctaaacgtttaaccccgaaagggaaaacctaaccttaacgggtttaggttaacttaccgttacgggaaccgtaaagtaacggaaaaccctaaaccccgtaggtaaaccggaaccccggaacgggtaaccggtaaccggggtagttaacgttatttacgtacggtaccgacggttaaggacgggtaagggttcggggggtttaaccttacccgggtttcggggtttaccggggttaacccgttttttcggtttaacggg

SEQ ID NO: 362116 - DNA, 672 bp, Homo sapiens
  misc_feature: GZ8MTXP01ERJ64.45.39.D06.1.454.CMB.2.raw
  modified_base (282)..(282): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccggggagcgtggtccagcctgggagtccctgacactctcctgtgaagcgctggactcaccttcagtgntagtcggtccttctacgtcgggtccgccgtacggttccgacggcgaacggggcgtcgggaggtgggttgggtcgtgtaagttagttaagtaggtagtagtagtagggtaggagtaacgtaaactaacgtttacgtacgtaacgtaaccgtacccggtacggtacggggtacccggtaacgttaccgtaacccgtaacgtaccgacccgaacgggaacggaaacgtaaacgttaaccgtaaacggaaaccgaacgtaacgttacgtaacgttacgtacggtacgtaagtaacgtaaacgaaaccgtacgaacgaacccggaacggaaccggttacgggttacggttaagttacgtttcgttcgtacggttacggtaacggaacggtaaggg

SEQ ID NO: 362117 - DNA, 572 bp, Homo sapiens
  misc_feature: GZ8MTXP01A3Q3I.45.39.D06.1.454.CMB.2.raw
  modified_base (377)..(377): a, c, t, g, unknown or other
  modified_base (431)..(431): a, c, t, g, unknown or other
  modified_base (514)..(514): a, c, t, g, unknown or other
tcagacgcgatcgacacgaccggtgctcgatttagtgacatctcgcagttctttgggggctctgggagaggagcccagcactagaagttggcggtgtttccattcggtgatcagcactgaacacagaggactcaccatggagtttgggctgagctgggttttcctcgttgctcttttaagaggtgtccagtgtcaggtggaagtggtgcgaggtccgggggagcgtggtccagccgtgggacggtccctgacactctcctgtgagcgcctggactcaccttcagtggctagtggcctttcacgtcggggtcccgccgtagggttcccagggcgaaggggggctgggagtggttggctgatatatggtatgatggaanagaactaaacatttgacagacgtcggtggacggggccagttcacatcgacaganacattccaggaacacgagttgtatctggacaatgaacaacctgaacgacccgaggacgaacggtgttatacttcgtgcgcggngagtaaggtgggggttcgttacgttcggggttaccgggtaaccgttttcgtttaacgg

SEQ ID NO: 362118 - DNA, 541 bp, Homo sapiens
  misc_feature: GZ8MTXP01EIZE4.45.39.D06.1.454.CMB.2.raw
  modified_base (304)..(304): a, c, t, g, unknown or other
  modified_base (358)..(358): a, c, t, g, unknown or other
  modified_base (368)..(368): a, c, t, g, unknown or other
  modified_base (490)..(490): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagccgtgggacgtccctgacactctcctgtgaagcgcctggactcacctcagtggctatggccttcactgggtccnccaggttccaggcaagggggctggagtggttggctgatatatggtatgatgganaagactaacntttgcagactcggtggacgggcgatcacatcgcagagacaattacaagaacacgtattagggtatctaggacaatagaacacctagacgaccgagacacggtgtattagttcttgcgcgagngttaggtgggggttctaacggttggttcgggttactttcgtttaagtcggg

SEQ ID NO: 362119 - DNA, 550 bp, Homo sapiens
  misc_feature: GZ8MTXP01EGQRE.45.39.D06.1.454.CMB.2.raw
  modified_base (383)..(383): a, c, t, g, unknown or other
  modified_base (411)..(411): a, c, t, g, unknown or other
  modified_base (487)..(487): a, c, t, g, unknown or other
  modified_base (503)..(503): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagccgtgggacggtccctgacactctcctgtgaagcgctggactcaccttcagtggctatcggccttcacgtgggtcccgcctagggttcccaggcgaagggggctgggagtggttggctgatatatggtatgatggaagagaactaaacnctttgcagactcgtagacgggcatcacntcgacagagacaataccaagaacactagttgtatcgtaggacaagtgaacaacgtgacgacccgagacgaacggtnttatacttgtgcgcgngacgtggtggggttctacggttgggttcgggttcgttttcgtttaag

SEQ ID NO: 362120 - DNA, 588 bp, Homo sapiens
  misc_feature: GZ8MTXP01BU8BI.45.39.D06.1.454.CMB.2.raw
  modified_base (388)..(388): a, c, t, g, unknown or other
  modified_base (505)..(505): a, c, t, g, unknown or other
  modified_base (518)..(518): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagccgtgggagtccctgacactctcctgtgagcgcctggactcacctcagtggctatggcccttcacgttggggtccccgccgtaggtttcccagggtccgaaagggggctgggagttgggttggctgatagtagtggtatgagtggagaagaactaacnctttgacagcctcggtggacggggccatcacatcgcagagacatccagaacactatggtatcgtgacaatacgaacaacgtagacgacccgaggacgtacgggtaagtattagttcnggtacgcggaggnggttagggttcgggggttcctaacggtttcggggttccggggttaccgtttttcgtttaacggttcgggg

SEQ ID NO: 362121 - DNA, 641 bp, Homo sapiens
  misc_feature: GZ8MTXP01CQ3TX.45.39.D06.1.454.CMB.2.raw
  modified_base (249)..(249): a, c, t, g, unknown or other
  modified_base (257)..(257): a, c, t, g, unknown or other
  modified_base (273)..(273): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcggtggtttcgcgtaggctctttaagaggtgtcagtgtcaggtggaagtggtgcgaggtccgggggagcgtggtccagcctgggagtccctgaccnctctctgngacgcgctgctcactnagtgctagtcgccttacgacgtcggtcccgaccgtaggttccgaggacggaaggggtcgtagggagtgtagttcggctgtagtagtagtgtagtgtagtaaggagaagtaaactaaactacgttagtacgacgtacgtacggtacggtacgggacggtacgtacgaccgacgtacgaccgacgaacgaacgtaacgtaacgaacgtaacgtacgtagttagttacgtacgtagtacgtaagtacgaaacgaacgtacgacggaaccggacggtaacggtacggttagttacgttacgttacgtcgcgcggaggtaaggtagggttcgggttcggttacggttacgggtttccgggtttccgtttaacg

SEQ ID NO: 362122 - DNA, 546 bp, Homo sapiens
  misc_feature: GZ8MTXP01EXS3A.45.39.D06.1.454.CMB.2.raw
  modified_base (303)..(303): a, c, t, g, unknown or other
  modified_base (366)..(366): a, c, t, g, unknown or other
  modified_base (504)..(504): a, c, t, g, unknown or other
  modified_base (508)..(508): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgaagcgcctggactcacctcagtggctatggccttcacgtgggtcccncaggttccaggcaagggggctggagtggttgctgatatatggtatgagtggagaagactaacncttgcagacgtcggtgggaacggggcgtacgttcacatcgaccagagaacaacttaccgaagaacactattagggtatcgtaggacaatagaaacaacgtacgacgaccgaggacgacggtaagtattattcttgcgngagngagtggggtctaacgttggtcggttctttcgttgtcgg

SEQ ID NO: 362123 - DNA, 727 bp, Homo sapiens
  misc_feature: GZ8MTXP01A0BX9.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgagcgctggactcaccttcagtgctatcggccttcacgtcgggtcccgccgtaggttcccagggtcgaagggggctgggagtgggttggcttaggattagtatggtatgatgggaaagagaactaaactacgtttgactaagaccgtccgggtagggacgggggtccgtacttccaacccgtagtcccggaccgaacggaacggaaacctaaacgttacccgaaacgggaaactaaccttaacggtttaggttaacttaccgttagggtaaccgaaattacggaaaacctaaacccgtacggtaaaccggaaccccggacgggaaccggtaaccggggtagttaaggttaactttcgtacgggtccgacggttagggacgggttaagggttcggggggtttaacccgtttacccgggtttcgggggttttacccgggggttaacccgttttttaacccggttttaaggg

SEQ ID NO: 362124 - DNA, 580 bp, Homo sapiens
  misc_feature: GZ8MTXP01DR1TB.45.39.D06.1.454.CMB.2.raw
  modified_base (245)..(245): a, c, t, g, unknown or other
  modified_base (530)..(530): a, c, t, g, unknown or other
  modified_base (535)..(535): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcgtggtttcgcgtaggctctttaagaggtgtcagtgtcaggtggaagtggtgcgaggtccgggggaggcgtggtccagcctgggagtccctgacnctctcctgtgaagcgcctggactcacctcagtggctagtcggcctttcgacgtcgggtcccgccgtaggttcccgaggccgaaagggggtctgggaggttgggttggctagatatagtggtatgagtggagaaagtaactaacgctttggactagacctcggtgacggggcctattccaacacgcgacgacgacgactaactacgaacgaacactattaggtactcgtacgtacgaatacgaacaacgacgacgacgacgacgagtaagtattatcgttcgacgngaggnggttaggtgggttcgttcgttcggttcggttacgtttcgttgtcg

SEQ ID NO: 362125 - DNA, 554 bp, Homo sapiens
  misc_feature: GZ8MTXP01B8GO8.45.39.D06.1.454.CMB.2.raw
  modified_base (302)..(302): a, c, t, g, unknown or other
  modified_base (480)..(480): a, c, t, g, unknown or other
  modified_base (507)..(507): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggagtccctgacactctcctgtgaagcgcctggactcacctcagtggctatggccttcactgggtccncaggttccaggcaagggggctggagtggtggctgatatatggatgagtggagaagaacttaacacttttaggacagactcccggtgggacggggccgtattcaccatccgccaagacgacaacttaccagaacacattggtatcgtgacaatgaacaactacgacgacccgaggacgngggtaacgtattattcgttgcgcgagngagtgggggttctaacgtttggtcgggttacctttccgttgttcggg

SEQ ID NO: 362126 - DNA, 728 bp, Homo sapiens
  misc_feature: GZ8MTXP01C3IJR.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtccgggggagcgtggtccagcctggggagtccctgacactctcctgtgaagcgcctggactcaccttcagtggctagtcggccttcgacgtgggtcccgccgtaggttcccagggcgaacgggggctgggagtggttgctgatatagtggtatgatggaagagaactaaactactttggacctaggaccgtccggtagggaacgggggccgtaagttaccaccagttaccggacccaaggaacgaaccgaaacttcccgaaagggtaaaccaactaaggtttaggttaaacttccgttagggaaccgtaaaacgtaacgtaaaccgtaaaccgtaacggtaaaccggaacccggaaaccgggaaccggtaacgggttaacggttaacgttaacgtttacgttacggtacggacgggttacgggttacgggtaacggggttacgggggtttaaccgggtttaccgggtttaccggggtttaccggggtttaacccggttttaaccggtttaacgg

SEQ ID NO: 362127 - DNA, 696 bp, Homo sapiens
  misc_feature: GZ8MTXP01BH5X8.45.39.D06.1.454.CMB.2.raw
  modified_base (392)..(392): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagccgtgggacggtccctgacactctcctgtgagcgctggactcaccttcagtggctagtcggcccttacgacgtggggtccccgccgtagggttcccaggcgaagggggctgggagtgggttgctgatatagtggtatggatggaagacgaactaaacnctttgactaagacgtccggtggacggggtccgtagttccaccgtaagtcccgaccgaacggacggaacctaaacttacccgaaggaaacacctaacgtttgtaacgttcctagggacctaaagtacggaaaccaaaccccgtaggaaccggaaccccggaacggtacccggtaacggggttaagttacgttaacgtttccgtagggtaccgaccgggttaggacgggtaagggttacggggggtttccgttaaccggtttcgggggtttacccggggttcccgttttttaaccgttttaacggg

SEQ ID NO: 362128 - DNA, 524 bp, Homo sapiens
  misc_feature: GZ8MTXP01D5SY1.45.39.D06.1.454.CMB.2.raw
  modified_base (307)..(307): a, c, t, g, unknown or other
  modified_base (361)..(361): a, c, t, g, unknown or other
  modified_base (372)..(372): a, c, t, g, unknown or other
  modified_base (485)..(485): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctggggaggtccctgacactctcctgtgaagcgcctggactcacctcagtggctatggccttcactgggtcccncaggttccaggcaaggggctgggagtggttggctgatatatggtatgatggaanagaactaaacnctttgcagactcgtgagggcgatcacatcgcagagacataccagaacacattgtaatctggacaatgaacaacctgacgacccgaggacaacgggtgttatattcgtgcgcgngagaagtgggggtctacgtggttcggggtcctttcgttg

SEQ ID NO: 362129 - DNA, 641 bp, Homo sapiens
  misc_feature: GZ8MTXP01AFC6Q.45.39.D06.1.454.CMB.2.raw
  modified_base (162)..(162): a, c, t, g, unknown or other
  modified_base (561)..(561): a, c, t, g, unknown or other
  modified_base (573)..(573): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttccncgttgctcttttaagaggtgtccagtgtcaggtggaagtggtgcaggtccgggggagcgtggtccagcctgggagtccctgacactctctgtgagcgcctggactcacctcagtggctagtcggcccttcacgtcgggtcccgccgaggttcccgagggccaagggggctgggagtggttggctgatatagtggtatgagtggagaagaactaacgtcttaggacacggtacctccgggtagggacggggacccgtattaccgaccaacgtccgcccaaggacgaactaacttacccgaaggaaactaactaattgggtaactcgttacggacgtaaatcggaaacaaccgtacgaacggaccccgaagggaccgtacgggtaagtaattacgtttcgngcggacgagggngttagggtcgggggttactaaccggtttcgggttaccggggttaccttttcccggttaagttccgggg

SEQ ID NO: 362130 - DNA, 848 bp, Homo sapiens
  misc_feature: GZ8MTXP01A3KCP.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctctgtgacgcgcctggactcacctcagtggctagtcggtcccttcgacgtcggggtcccgcccgtagggtttcccaagggccgaaagggggtccgtggggaggttgggtttggcgtggaattagtagtggtatggagtagggagtaaacgtaacttaaacgtacgttttcgacgtaaggtacccgttcccgggttagggaaccgggggtacccgtaacgtttacccgaacccgtaacgttacccggacccgtaaacgggaaacggtaaaccctaaacgtttaaccccggaaacgggaaaaccctaaccgttaagtttacgggttaacgttaccggtttacgggaacctaaaacgttaaccggaaacccgtaaacccgttaacgggaaaccggtaaccccgggaaacgggtaacccgggtaaccggggttaagttaacgtttaaacgtttccgttacggttaccgggaaccgggttaacgggttaagggttacggggtttaaccggggggtttacccgtttaacccggggttttcgggggtttacccgggggttttaacccgttttttcccggttttaacggtttaacccggggg

SEQ ID NO: 362131 - DNA, 819 bp, Homo sapiens
  misc_feature: GZ8MTXP01BV0BJ.45.39.D06.1.454.CMB.2.raw
  modified_base (274)..(274): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccggggagcgtggtccagccgtgggacgtccctgacactctctgtgagcgctgactcactnagtgctagtcggccttcgacgtcgggtcccaccgtacggttaccagggcgaagggggtcctaggggagttgggttaggcttggaattagtagttggtatggagtacggggaagtaaacgtaaacttaaacgtacgtttttacgggaaacgtaccgttcccgggtaggggaaccgggggtacccgttaacgttacccgaacccgtaacgtcccggaacccgtaaaggaaacggtaacctaaaccgtttacccgaaacgggaaacccgtaacttaagtttacggttaacgttacggttacggggaaacctaaacgttaccggaaaaccctaaaccccgttaggaaacccggtaacccccgggaagggtaacccgggtaccggggtttaagttaacgtttaacgttttcggtacggacggtaaccgggtaaggttaggggttacggggtttccggggggtttaaccctttcccggggttttaacggggttttacccgggggtttacccttttttaccgggtttaacgggttccgggtttaacccgggg

SEQ ID NO: 362132 - DNA, 801 bp, Homo sapiens
  misc_feature: GZ8MTXP01AR1ID.45.39.D06.1.454.CMB.2.raw
  modified_base (251)..(251): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacnctctctgtgagcgcctggactcacctcagtggctatcggccttcacgttcgggtccccgccgtaggtttcccgagggtcgaaaggggggccttggggaggttgggttggcttagattagtagtgggtatggaagtgggaagtaaacgtaacttaacgtacgtttaggacctaaggtacccgttaccggggtagggaaccgggggtcccgtaacgtttacccgaacccgtaacgtcccggaccgaaacgggaacggtaaacctaaacgttaccccgaaacgggtaaacctaacgttaacgtttacggttaacttacggtacgggtaactaaacgttaccgaaaaccgtaacccgttacggaaaccggtaaaccccgggaaacggtaaccggtaaccggggttaagtttaacgttaacgttttccgacgggacccgtagggttaaacgggttacgggttacggggttaacgggggtttaccctttaaccggggtttcgggggtttacccggggtttaccctttttaaccgggtttaagggttaacccggggg

SEQ ID NO: 362133 - DNA, 617 bp, Homo sapiens
  misc_feature: GZ8MTXP01AWCJ0.45.39.D06.1.454.CMB.2.raw
  modified_base (252)..(252): a, c, t, g, unknown or other
  modified_base (388)..(388): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagcctgggacgtccctgacnctctcctgtgagcgctgactcaccttcagtggctagtcggccctttcacgttcggggtccccgccgtaggttccccagggcgaagggggctgggaggttgggtgcttggattagtagtgggtatgaagtgggaaanagtaactaaactcttgacagacctcggtaggacgggcgattcacatcgacgagagaacaataccaaggaacacgtagttagtatcgtagacaagtacgaaacaaccgtgaaccgaccgacggacgtaacggtagttatagttcgtacggcgttacggaggacggtaagggttacgggggttccgttaccggttcggggttaccgggttaacccgttttcgtttaacggg

SEQ ID NO: 362134 - DNA, 704 bp, Homo sapiens
  misc_feature: GZ8MTXP01BDUNK.45.39.D06.1.454.CMB.2.raw
  modified_base (291)..(291): a, c, t, g, unknown or other
  modified_base (332)..(332): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgtggtttcctcgtagctctttaagaggtgtccagtgtcaggtggaagtggtgcaggtccgggggagcgtggtccagccgtgggagtccctgacactctcctgtgaagcgctggactcacttcagtgctatggccttnactggtccgcaggttccaggcaaggggctggagtgattggntgatatagtgtagtgagtagggaacgaagtaaactaaacgtcgttgacgtacgtacgtcggtagggacggggtacctacgttaccgaaccgtacgtacccgaccgtaaggaacgtaactaacgttacccgaaaggtaaaccgtaacggttaagtttacgtacgtacggtacggtaacgtaacgtaacgtaaaccgtaaccgtaacggtaaccggtaacccggaaccgggtaacggtaacgggttacggttaacgttacgttacgttcggttaccggttacgggttacgggtaacgggtacgggttaacgggggtttaccgggttaccgggtttaccggggtttaaccggggtttaacccggttttaacccgg

SEQ ID NO: 362135 - DNA, 674 bp, Homo sapiens
  misc_feature: GZ8MTXP01BRNDY.45.39.D06.1.454.CMB.2.raw
  modified_base (380)..(380): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgagcgctggactcaccttcagtggctagtggcccttcacgtgggtcccgcctaggttcccaggcgaagggggctgggagtgggttgctgatagtagtggtatgatggaaagagaactaaacnctttgctaagccgttccggtaggacggggtaccgtacgttaccaccgagttccgaccgaagaacgtaaccaaacgttacccgaaggaaaccacgtaagttgtacttccgtaggactaaacgtacggaaaccaaaccgtacggaacggaaccccggaagggaacccgtaacggggttacgttaagttacgtttcgtacggtacggacggaaggttacggtaagggttcggggggttaaccgttaccgggtttcggggtttaccggggttaacccgtttttaaccggtttaacggg

SEQ ID NO: 362136 - DNA, 800 bp, Homo sapiens
  misc_feature: GZ8MTXP01DA3SW.45.39.D06.1.454.CMB.2.raw
  modified_base (251)..(251): a, c, t, g, unknown or other
  modified_base (313)..(313): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggagtggtgcgaggtccgggggagcgtggtccagccgtgggagtccctgacnctctcctgtgagcgcctggactcaccttcagtggctagtcggcccttcgacgtggggtcccnccagggttccccagggccgaagggggctgggaggtggttggctgatatagtggtatgatggaaagagaactaaactcgtttagaccgaagtaccgtccgggttagggacgggggtaccgtaacgtttaccgaacccgtaacgttcccggaaccgaacggtaacggaaacctaaaaccgtttaacccgaaacggggtaaaacctaacccgtaaaggttttaacggttaacgttacccggttaaggggtacctaaaacgttaacggaaaacccgtaaaaccccgttaggtaaacccggaaacccccgggtaaacggggtaaacccggtaaccgggggttaagttaaacgtttaaacgttttccgtacggtaccggttaccgggttagggttaacgggtaacggggttacggggggttttaaccctttaaccggggtttcgggggttttacccgggggtttaacccgttttttaaccggttttaaccggg

SEQ ID NO: 362137 - DNA, 543 bp, Homo sapiens
  misc_feature: GZ8MTXP01A83H3.45.39.D06.1.454.CMB.2.raw
  modified_base (363)..(363): a, c, t, g, unknown or other
  modified_base (492)..(492): a, c, t, g, unknown or other
  modified_base (497)..(497): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgaagcgcctggactcaccttcagtggctatggccttcactgggtccgccaggttccaggcgaagggggctgggagtgggttggctgatatatggtatgatggaanagaactaaacactttgcagctccgtgagggcatcacatcgccagagacaattccaggaacacagttgtatctggacaatacgaacaacctgacgaccgaggacgaacgggtgttactattcgtgcgcgngaggnggtgggggtcttacggttgggttacgggtccgttttcgtttaacgg

SEQ ID NO: 362138 - DNA, 643 bp, Homo sapiens
  misc_feature: GZ8MTXP01AOZVQ.45.39.D06.1.454.CMB.2.raw
  modified_base (253)..(253): a, c, t, g, unknown or other
  modified_base (262)..(262): a, c, t, g, unknown or other
tcagacgcgatcgacacgaccggtgctcgatttagtgacatctcgcagttctttggggctctgggagaggggcccagcactagaagtcggcggtgtttccattcggtgatcagcactgaacacagaggactcaccatggagtttgggctgagcgtggtttcgcgtaggcgtctttaagaggtgtcagtgtcaggtgaagtggtgcagtccgggggagcgtggtccagcctgggagtccctgacactctcctgngaagcgtcngactctactgagtgctgtcgtctcgtcgtcggtccgccgtacggtcgacggacggacgggtcggtggtaggttggttggtcgtagtagtagtagtacggtatagagtaggagaaagtaacgtaacgtacgttagacgtacgtacgtacggtacgggacgggtacgtacgtacgacgacgtcgacgacgacgactactacgacgaactactagttacggtacgtacgtagacgaagtacgaacgaacgtacgacggtaccgaacggacgtacggtaacgtagttagttcgttcgtcggacgaggttaggttagggttcggggttacggttaaccggtttcgggtttaccgggttaccggttttaaccgtttaacggttaagg

SEQ ID NO: 362139 - DNA, 644 bp, Homo sapiens
  misc_feature: GZ8MTXP01EEL2F.45.39.D06.1.454.CMB.2.raw
  modified_base (281)..(281): a, c, t, g, unknown or other
  modified_base (565)..(565): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcgaggtggaagtggtgcgaggtccgggggagcgtggtccagccgtgggacgtccctgacactctcctgtagagcgctggactcactnagtgctagtcggccttcgacgtcgggtcccgcctagggttcccaggacgaagggggtctagggaggtgggtgctagatagtagtggtatggagtgggaaataagaactaaactactttggactagtaccgtcggtaggacgggcgtatcacacgtcgaccagacgacacttaccgaagaactactagttacgtacgtactaggactaaatagaaaccgtaacccgagtaaccggaccccggtaagggaaccggtaaggttacgttaagttactttcgaggacgngggaggttagggtgggttacgggggtttccgttaacgggtttcggggtttaccgggttaaccgtttttcgtttaacggg

SEQ ID NO: 362140 - DNA, 522 bp, Homo sapiens
  misc_feature: GZ8MTXP01BKCSQ.45.39.D06.1.454.CMB.2.raw
  modified_base (362)..(362): a, c, t, g, unknown or other
  modified_base (421)..(421): a, c, t, g, unknown or other
  modified_base (472)..(472): a, c, t, g, unknown or other
  modified_base (480)..(480): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctggggagtccctgacactctcctgtgaagcgcctggactcactcagtggctatggccttcactggtccgcaggttccaggcaagggggctggagtggttgctgatatatggtatgatggagaagactaanactttgcagactcgtgacgggcgatcacatcgccagagacactcagaacacattgtatntggacaatcgaacaacctagacgacccgaggacacgggtgtattatttcgngcgcgagngagtggggtctaacgttgggtcgggttacctttcgttgtggg

SEQ ID NO: 362141 - DNA, 565 bp, Homo sapiens
  misc_feature: GZ8MTXP01B1XB7.45.39.D06.1.454.CMB.2.raw
  modified_base (305)..(305): a, c, t, g, unknown or other
  modified_base (373)..(373): a, c, t, g, unknown or other
  modified_base (388)..(388): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagcctgggagtccctgacactctctgtgagcgctggactcaccttcagtggctatggccttcactggggtcccnccaggttcccaggcaagggggctgggagtggttgctgatatagtggtatgatggaagagaactaaacnctttgctagactcgngaggggcagtcacatcgacagagacaattccaaggaacacgattagtatcgtggacaatgaacaacctgacgacccgagggacgaacgggtgttacgtattacgtcgtcgcgagaggtaaggttggggggttccttacgggttcgggttaccggggttccgttttcccgttttaagg

SEQ ID NO: 362142 - DNA, 722 bp, Homo sapiens
  misc_feature: GZ8MTXP01BDQWC.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttctttttaaagaggttgtccagttgtcaggtggaagtggtgcaggtccgggggagcgtggtccagccgtgggacgtccctgacactctctgtgaagcgcctggactcacctcgagtgctagtcggtcccttcacgtcgggtcccgccgaggttccaggcgaagggggctggagtggttggctgatatagtggtatgagtggaagaagtaactaactctttgactagtaccgtccggtagggacggggtcctagttccaaccgactcccggaccgaaggaacgaaccgtaaacgttaccgaaacgggtaaacctaaccgtaagtttacggtaacttccgttacgggacaaacgttacgaaaccctaacgacggaaccgtaacccggaacggaaccgtaccggggttaagtaacgttacgtttccgttaggaccggtacggttaagggttacgggttacggggtttcggggggtttacccgtttaacccgggttttcgggggtttacccggggttttacccgtttttaacccggttttaaggttaacccggggg

SEQ ID NO: 362143 - DNA, 657 bp, Homo sapiens
  misc_feature: GZ8MTXP01AKOM8.45.39.D06.1.454.CMB.2.raw
  modified_base (318)..(318): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctctttaagaggtgtccagtgtcgaggtggaagtggtgcgagggtccgggggaggcgtggtccagccgtgggacgtccctgacactctcctgtgagcgcctggactcaccttcagtcggctatcggcccttcgacgtcggggtccccnccgtagggttcccagggccgaagggggcctgggaggttgggttggctgatatagtggtatggagtggaaagagaactaaacgtcgtttgacagaccgtcgggtagggacggggtccgtaagttccaaccgacgtccgacccgagacgaacaacttccgaacggaacacgtagttaggtaatcgtaggacaagtacgaaaccaaccgtgaaccgacccgaaggaccgtaacgggtagttattacgtttcgtggacccgttggacggaggtaacgggttcgggggtttaaccttaccggtttcggggttaccggggttaaccgtttttcccgttttaaggg

SEQ ID NO: 362144 - DNA, 621 bp, Homo sapiens
  misc_feature: GZ8MTXP01ANYLY.45.39.D06.1.454.CMB.2.raw
  modified_base (274)..(274): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgagcgctggactcacctnagtggctagtcggccttcgacgtcgggtaccccgccgtacggtttccgagggcgaaagggggtctgggacggttgggttggctgatagtagtcggtatgagtggagaagactaactactttgacagacgtcgtaggacggggccgtatcacgactcgacagacgaacaactaccgaagaacactagttacggtaatcgtaggactaaagtacgaaacaaccgtagaaccgtaccggaaggacgacgggtaagtattacgtttacgcgacggtcgagggttaggttagggttcgggggttacgttccggtttcggggttaccggtttacctttttcgttgttaacggg

SEQ ID NO: 362145 - DNA, 531 bp, Homo sapiens
  misc_feature: GZ8MTXP01BYYP7.45.39.D06.1.454.CMB.2.raw
  modified_base (250)..(250): a, c, t, g, unknown or other
  modified_base (305)..(305): a, c, t, g, unknown or other
  modified_base (357)..(357): a, c, t, g, unknown or other
  modified_base (365)..(365): a, c, t, g, unknown or other
  modified_base (465)..(465): a, c, t, g, unknown or other
  modified_base (483)..(483): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagcctgggagtccctgacnctctctgtgagcgcctggactcaccttcagtggctatggccttcactgggtcccnccaggttccaggcaaggggctggagtggtgctgatatatggtatgatggaanagctaaancttgcagactcgtgaggcagtcacatcgaccagacacaatccaaggaacacagttgtactcaggacaatgaacaactgacgacccgaggacgaacgggtnttatagttcgtgcgacgngaggtaagtgggggttctacggttggttaccgggtccttttcgttaag

SEQ ID NO: 362146 - DNA, 538 bp, Homo sapiens
  misc_feature: GZ8MTXP01D3PFT.45.39.D06.1.454.CMB.2.raw
  modified_base (302)..(302): a, c, t, g, unknown or other
  modified_base (367)..(367): a, c, t, g, unknown or other
  modified_base (478)..(478): a, c, t, g, unknown or other
  modified_base (492)..(492): a, c, t, g, unknown or other
  modified_base (496)..(496): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggagtccctgacactctcctgtgaagcgcctggactcacctcagtggctatggccttcactgggtccnccaggttccaggcgaaggggctggagtggttggctgatatatggtatgatggagaagaactaacnctttgcagactccggtaggacgggcgattcacatcgaccaagagacaataccagaacactattggtatctaggacaatagaacaactacgacgacccgaggacgacgggtntattattcttgcgngagngagtggggtctaacgttggtcggttactttcgttaagtcggg

SEQ ID NO: 362147 - DNA, 564 bp, Homo sapiens
  misc_feature: GZ8MTXP01ER6Y0.45.39.D06.1.454.CMB.2.raw
  modified_base (367)..(367): a, c, t, g, unknown or other
  modified_base (378)..(378): a, c, t, g, unknown or other
  modified_base (502)..(502): a, c, t, g, unknown or other
tcagacgcgatcgacacgaccggtgctcgatttagtgacatctcgcagttctttggggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgaagcgcctggactcaccttcagtggctatggccttcacgtgggtcccgcaggttcccagggcaagggggctgggagtgggttggctgatatatggtatgatggaaanagaactaaacnctttgcagactcggtggagggcgagttcacagtcgaccagacgacaacttaccaaggaacactagttagtatctggacaatacgaacaacctgacgacccgagacgaacggtgttatatttcgngcgcgagagtaaggtcgggggttcttacggttgggttccgggtaaccgttttcgtttaacgg

SEQ ID NO: 362148 - DNA, 654 bp, Homo sapiens
  misc_feature: GZ8MTXP01CECGJ.45.39.D06.1.454.CMB.2.raw
  modified_base (254)..(254): a, c, t, g, unknown or other
  modified_base (281)..(281): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacnctctcctgtgagcgcctgactcacctnagtggctagtcggccttcacgtgggtcccgcctagggttccagggcgaagggggctgggagtgggttggctgatatacgtggtatgagtcggaaagaagaactaaactctttggacaggtaccgtcgggtaggacggggccgtattccaccatccgaccagaacgacaacttaccgaaggaactaactagttacgtataccgtaggacaatacggaaacaaccgtagaaccggacccgaacggacggtaacgggtgttaattacgttcgtacggtcggacggttaggttacgggtaagggttacggggggttccgtttaacccgggtttcggggtttacccggggtttaacccgtttttccgttttaacgggg

SEQ ID NO: 362149 - DNA, 588 bp, Homo sapiens
  misc_feature: GZ8MTXP01BKU8Z.45.39.D06.1.454.CMB.2.raw
  modified_base (303)..(303): a, c, t, g, unknown or other
  modified_base (499)..(499): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggacgtccctgacactctcctgtgaagcgcctggactcactcagtggctatggccttcactgggtcccncaggttccaggtcaagggggctgggagttgggttggctgatatagtcggtatgatggagaagtaactaacgctttgactagacctccggtaggacggggccgtattccaccatcgcaagacgacataccgagaacacattggtatctaggacaatcgaacacctagacgaccgaggacgacggtgtagttattcgngtcgcgaggttcggttaggttcggggggttccgttaaccggtttcggggttaccggggttacccgtttttcgtttaacggttaacgggg

SEQ ID NO: 362150 - DNA, 748 bp, Homo sapiens
  misc_feature: GZ8MTXP01AQV6Z.45.39.D06.1.454.CMB.2.raw
  modified_base (311)..(311): a, c, t, g, unknown or other
tcagacgcgatcgacacgaccggtgctcgatttagtgacatctcgcagttctttgggggctctgggagaggagcccagcactagaagtaggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctcctgtgagcgctggactcaccttcagtgctatcggccttcacgtcgggtcccnccgtaggttcccaggcgaagggggctgggagtggttggctgatagtgtggtatgatggaaagagtaactaaactcgtttagacgtagaccgtccgggtagggacgggggtaccgtacgttaccgaaccgtacgtacccggacccgaaggaacgtaacctaaacgttacccgaaacgggtaaacctaaccgtaagtttacggttaacgttaccgtagggtaaccctaaagttacgaaaacccgtaaacccgtacggaaacccgggtaaccccggaacgggtaaacccggtaacggggttaagttaacgtttacgtttccgtacggaccggttacgggttacggttagggttaacggggttcggggggtttaaccctttacccggggtttcgggggtttacccggggtttaacccgttttttcccggttttaaccgggg

SEQ ID NO: 362151 - DNA, 639 bp, Homo sapiens
  misc_feature: GZ8MTXP01AMB8Y.45.39.D06.1.454.CMB.2.raw
  modified_base (374)..(374): a, c, t, g, unknown or other
  modified_base (386)..(386): a, c, t, g, unknown or other
  modified_base (547)..(547): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctcctgtgagcgcctggactcacctcagtggctagtcggcccttcacgtggggtcccgccgtaggtttcccagggcgaagggggctgggagtggtggctgatatagtggtatgagtgganaacgaactaacnctttgacagacgtcggtgggacggggccgtagttcacacgtccgcaagagaactaactaccgaaggaaacactacgttaggtactacgttagacgtaatacgaaaccgaaccgtacggaacgtaaccccggaggacgtaacgggtaagtattacgtttcgnggcgtcgaggaggttagggttcggggggtttacgttaaccggtttggggttacccgggtttaccgtttttccggtttaacggttaaccgggg

SEQ ID NO: 362152 - DNA, 630 bp, Homo sapiens
  misc_feature: GZ8MTXP01E287Y.45.39.D06.1.454.CMB.2.raw
  modified_base (279)..(279): a, c, t, g, unknown or other
  modified_base (296)..(296): a, c, t, g, unknown or other
  modified_base (307)..(307): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggaggcgtggtccaggccgtgggacgtccctgacactctcctgtgagcgctggactcacctnagtgctagtcggccttnacgtgggtccnccgaggttccaggcgaaggggctggagttggtgctgatatagtggtatgagtggagaaagtaactaacgtctttgacacggtactaccgggtaggacggggacctagttccgaccactccgacaagacgaacaacttacgaacggaacactattaggtactcgtaggacaaagtacgaaaccgtaaccgtacggaacggaacccggacggaacggtacgggtaagtaattagttcgttcgcgtacgaggaggttacgggttgggggttccttaaccgggtttcgggttaccggggttaccttttaaccgtttaagttccgggg

SEQ ID NO: 362153 - DNA, 694 bp, Homo sapiens
  misc_feature: GZ8MTXP01DYPTK.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagtctgggttttcctcgttgcttcttttaagaggtgtccagtgtcgaggtggaagtggtgcaggtccgggggagcgtggtccagccgtgggacgtccctgactactctctgtgagcgctggactcacctcagtggctagtcggtcccttcgacgtcgggtcccgccgaggttccccgagggtcgaaagggggtctgggtaggtcgggttggctagatagtagtggtatgtagtggaaagagtaactaaactactttgacaggtacgtccgggtaggacggggtcctattaccaccatccgaccgagaacgacctaacgttacccgaaggtaaactacctaaggtttacgtatcgtaggactaaagtcgaaaccgtaaccgaggaaccggaaaccccggaggaacccgtaacgggtaagttacgttaacgtttcgtaggacccggaggttaaggggttaacggtaacggggtttcgggggttaacccgtttaaccgggttcggggtttacccgggggttaacccttttttccgggttttaaggg

SEQ ID NO: 362154 - DNA, 566 bp, Homo sapiens
  misc_feature: GZ8MTXP01CR37O.45.39.D06.1.454.CMB.2.raw
  modified_base (278)..(278): a, c, t, g, unknown or other
  modified_base (304)..(304): a, c, t, g, unknown or other
  modified_base (342)..(342): a, c, t, g, unknown or other
  modified_base (358)..(358): a, c, t, g, unknown or other
  modified_base (413)..(413): a, c, t, g, unknown or other
  modified_base (489)..(489): a, c, t, g, unknown or other
  modified_base (496)..(496): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctctgtgagcgcctggactcacctnagtgctatggccttcactgggtcccnccaggttccaggcaagggggctggagtggtggctgatntagtggtatgatgganaagaactaacatttgactagacctccggtgacgggcctattcaccatcgacaganacaatccagaacactattgtatcgtgacaatgaaaccaactacgacgaacccgaggacgacggtgtaattagttcngtaccgngagaggttaggttgggggttaccgttccggtttgggttaccgggttaccgttttccgtttgttaaccggg

SEQ ID NO: 362155 - DNA, 591 bp, Homo sapiens
  misc_feature: GZ8MTXP01CRI6A.45.39.D06.1.454.CMB.2.raw
  modified_base (286)..(286): a, c, t, g, unknown or other
  modified_base (377)..(377): a, c, t, g, unknown or other
  modified_base (507)..(507): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggtttttcctcgttgcttcttttaagaggtgtccagtgtcaggtggaagtggtgcgagggtccgggggagcgtggtccagccgtgggacgtccctgacactctcctgtgaagcgcctggactcaccttnagtgctatggcctttcacgtgggtcccgcctaggttcccaggcgaaggggctgggagtggttgctgatatacgtggtatgagtggaaaganaactaaacatttgacagactcggtggacgggccgtattcgacatcgaccgagacgacacttaccgaaggaacactattcgtattcgtagactaatcgaacaaaccgtgaacgaccgaggacgaacgggtnttattattgtcggcgcggagacggtaagggttcgggggttcgttaccggtttgggttaccgggttaaccgtttttcgtttaacg

SEQ ID NO: 362156 - DNA, 742 bp, Homo sapiens
  misc_feature: GZ8MTXP01DEBH7.45.39.D06.1.454.CMB.2.raw
  modified_base (247)..(247): a, c, t, g, unknown or other
  modified_base (251)..(251): a, c, t, g, unknown or other
  modified_base (275)..(275): a, c, t, g, unknown or other
  modified_base (304)..(304): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtcggggagcgtggtccagccgtgggagtcccngacnctctctgtgagcgctgactcactnagtgctagtcggccttcacgtcgggcccnccgtaggttccgaggcgaaggggcgtgggagtggttggctgatatagtggtatgagtggaaagaagtaactaaactacgtttagacacgaccgtccgggtagggacggggtccctaacgttaccgaacctacgtaccgacccgtaaggacgtaaacgtaaaccgttaccgaaacggaacctaacgttaagtttacggttaattacgttacgggaactaaagttacggaaacctaaacccggtacggtaaaccggaaccccggaacgggaaccggtaaccgggggttacgttaaagtttaccgttttacggtacggtcgggaccggttaaacggggagggttaacgggggttttacggggggtttaacccgtttaaccggggttttcccgggggttttacccggggttttaacccgttttttcccggtttttaacgggg

SEQ ID NO: 362157 - DNA, 623 bp, Homo sapiens
  misc_feature: GZ8MTXP01C4MQ2.45.39.D06.1.454.CMB.2.raw
  modified_base (405)..(405): a, c, t, g, unknown or other
  modified_base (420)..(420): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggagtccctgacactctcctgtgagcgctggactcaccttcagtggctatcggccttcacgtgggtcccgcctaggttcccaggcgaagggggctgggagtgggttggctggatatagtgggtatgagtggaaagagtaactaaactctttggacagacctcggnggacgggcgatcacntcgcagagacaatccgagaacactagttgacgtctaggacaaagtacgaaactaaaccgtagtaaccggaacccgagggaccgaacggggttcttaattacgtttcgtacggcggaaccggttaggaggtaagggttccgggggttctttacccgggttcggggtttacccgggggtttaaccgtttttccggttttaacggg

SEQ ID NO: 362158 - DNA, 508 bp, Homo sapiens
  misc_feature: GZ8MTXP01CDY97.45.39.D06.1.454.CMB.2.raw
  modified_base (356)..(356): a, c, t, g, unknown or other
  modified_base (374)..(374): a, c, t, g, unknown or other
  modified_base (417)..(417): a, c, t, g, unknown or other
  modified_base (422)..(422): a, c, t, g, unknown or other
  modified_base (424)..(424): a, c, t, g, unknown or other
  modified_base (459)..(459): a, c, t, g, unknown or other
  modified_base (461)..(461): a, c, t, g, unknown or other
  modified_base (465)..(465): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtcggggagcgtggtccagcctggaggtccctgacactctcctgtgaagcgcctggactcacctcagtggctatggccttcactggtccgccaggtccaggcaaggggctggatggtggctgatatatggtatgatggagaagactaanactttgacagactccggngagggcatcacatcgacagagacatacgagaacatatgtatgngacananacaacagacgacgacgacgaggtgtattatcttgngngagngaggtgggtcgtaacgttcggttcgggttacgtttcgttgtgg

SEQ ID NO: 362159 - DNA, 599 bp, Homo sapiens
  misc_feature: GZ8MTXP01DRIYP.45.39.D06.1.454.CMB.2.raw
  modified_base (299)..(299): a, c, t, g, unknown or other
  modified_base (531)..(531): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcagggtggaagtggtgcgaggtccgggggagcgtggtccagccgtgggacgtccctgaccactctcctgtgaagcgctggactcaccttcagtgctatggccttnacgtgggtccgccaggttcccaggcgaaggggctgggagtggttggctgatatatggtatgatggaaagagaactaaactactttgacagactccgggtggacggggccgtattccacgtacgtacgaccgagacgaacaacttaccgaacggaaacactagttagttatcgtaggacaatagaacaactgacgaccggaggacgaacgggtgttatatttcgtgcggacgnggacggtaagggttgggggttccgttaccggttcggggttaccgggttccgtttttcgttttaacggg

SEQ ID NO: 362160 - DNA, 807 bp, Homo sapiens
  misc_feature: GZ8MTXP01A6HBC.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagcctggggacgtccctgacactctcctgtgagcgctggactcacttcagtggctagtcggcctttcacgtggggtcccgcctaagggtttccccagggtccgaaaggggggtccttggggacggttggggtttggcttaggattagttagtgggtaatggaatgggaagaagtaactaaaactcgtttgactaaggtaccgtccggtagggacgggggtaccgaagttccaaccgtacgttccgacccgaaggtaacgaaccgtaaacttaccccgaaagggaaacctaacccgtaagtttaggttaaacgttccgttacggggtaacaaaacgttacgtaaaaccccgaaacccgttacggtaaaccgggaaccccgggaaaggggaacccggtaaaccgggggtttagtttaaacgttaacgtttttacccgggtacgggtaccggttaaccgggttaggggttaacggggttaacgggggtttaccggggggttttaacccgtttacccggggttttaccgggggttttaccccgggggttttaacccgttttttcccgggttttaacggg

SEQ ID NO: 362161 - DNA, 546 bp, Homo sapiens
  misc_feature: GZ8MTXP01D0JBW.45.39.D06.1.454.CMB.2.raw
  modified_base (251)..(251): a, c, t, g, unknown or other
  modified_base (297)..(297): a, c, t, g, unknown or other
  modified_base (308)..(308): a, c, t, g, unknown or other
  modified_base (379)..(379): a, c, t, g, unknown or other
  modified_base (440)..(440): a, c, t, g, unknown or other
  modified_base (463)..(463): a, c, t, g, unknown or other
  modified_base (494)..(494): a, c, t, g, unknown or other
  modified_base (500)..(500): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtggaagtggtgcaggtccgggggagcgtggtccagccgtgggagtccctgacnctctcctgtgaagcgctggactcaccttcagtggcctatggccttnactgggtcccnccaggttcccaggccaagggggctgggagtggttgctgatactagtggtatgatcggaagagaactaaacnctttgacagactccggtgagggtcgatcgacatcgacagagacaatccaaggaacacattntatcgtagcgaatgaacaacgtnacgaccgagacgaaggtcgttatactttcgngcgcgngttaggtgtgggggtcttacgttgggttcgggttctttcgtttaag

SEQ ID NO: 362162 - DNA, 641 bp, Homo sapiens
  misc_feature: GZ8MTXP01CIEVN.45.39.D06.1.454.CMB.2.raw
  modified_base (561)..(561): a, c, t, g, unknown or other
  modified_base (566)..(566): a, c, t, g, unknown or other
tcagacgcgatcgacacgaccggtgctcgatttagtgacatctcgcagttctttggggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgactactctcctgtgaagcgctggctcacttcagtcggctatcggtccttcgacgtcggggtcccgtccgtagggttcccagggtcggaaaggggggtcctagggggagttggggttggacttggattagtacgttggtatggagtgggaaagacgtaactaaaactcgtttagcgaagaccgtcggtagggacgggtcctaattccaccgactcggaccaagacacgtaacttaccgaaggaacactaagttgtagtctaggacaaacgtagaaacctaacgtagaaccgaccggagacgtaacgggtnttatnttcgtagcgacggaggttaggtgggttcggggttccttccgggttcgggttccgggttccttttcgtttaacggg

SEQ ID NO: 362163 - DNA, 760 bp, Homo sapiens
  misc_feature: GZ8MTXP01AX0OF.45.39.D06.1.454.CMB.2.raw
  modified_base (255)..(255): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggattcaccatggagtttgggctgagcttgggttttcctcgttgcttcttttaagaggtgtccagtgtcaggtggaagtggtgcgaggtccgggggagcgtggtccagccgtggggacgtccctgacnctctcctgtgaagcgctggactcaccttcagtggctagtggccttcacgtgggtcccgccgaggttcccgaggcgaagggggtctgggtaggtgggttggctaggatagtagtggtatggatggaaagagaactaaactgtttagacagtacgtccggtaggacggggtaccgtagttacaccgactccggacccgaaggtaacgaaccgtaaacgttacccgaaacggtaaaccgaccttaaaggtttacggttaaacttacccggttagggaacctaaaacgtaacggtaaaaccgtaaacccggtaggtaaacccggaaccccgggaaacggtaacccgggtaaacggggttaccggttaagtttaaaccgtttacgtcgggtacccgggttacggttaacgggttagggttaacggggttacggggggtttaacccgtttaaccgggtttcgggggttttacccgggggtttaaccccgttttttcccgggttttaacggg

SEQ ID NO: 362164 - DNA, 574 bp, Homo sapiens
  misc_feature: GZ8MTXP01BCDFE.45.39.D06.1.454.CMB.2.raw
  modified_base (166)..(166): a, c, t, g, unknown or other
  modified_base (255)..(255): a, c, t, g, unknown or other
  modified_base (264)..(264): a, c, t, g, unknown or other
  modified_base (282)..(282): a, c, t, g, unknown or other
  modified_base (308)..(308): a, c, t, g, unknown or other
  modified_base (437)..(437): a, c, t, g, unknown or other
  modified_base (481)..(481): a, c, t, g, unknown or other
  modified_base (525)..(525): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgtgggttttccncgttgctcttttaagaggtgtccagtgtcaggtggaagtggtgcgagggtccgggggagcgtggtccagccgtggggacgtccctgacnctctcctgngagcgcctgactcacctnagtgctatggccttcagttcgggccnccgtaggttcccgaggcgaagggggctgggacggttggttaggcttaggatagtagtgggtatgagtcggaaagaagtaactaaactcttaggacaaggtctcggtggacgggcctaagtccacgtacncgacagactacactacgaacgacactagtagtagtacgagacanacgacacacgacgacgacgacgtcgtagttatattgtgcgacgnggaggtaaggtcgggttcggttcggttcggttacggttccgtttcgttg

SEQ ID NO: 362165 - DNA, 570 bp, Homo sapiens
  misc_feature: GZ8MTXP01BOEFB.45.39.D06.1.454.CMB.2.raw
  modified_base (254)..(254): a, c, t, g, unknown or other
  modified_base (419)..(419): a, c, t, g, unknown or other
  modified_base (457)..(457): a, c, t, g, unknown or other
  modified_base (472)..(472): a, c, t, g, unknown or other
  modified_base (505)..(505): a, c, t, g, unknown or other
  modified_base (519)..(519): a, c, t, g, unknown or other
  modified_base (524)..(524): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggtttttcctcgttgcttctttttaaggaggttgtccagtgtcaggtggaagtggtgcaggtccgggggagcgtggtccagccgtgggacgtccctgacnctctcctgtgacgcgcctggactcacctcagtggctatcggtcccttcgacgtcgggtccccgccaggtttcccaggggcgaaaggggggctaggggagttgggttggctggactagtagtggtatggagtggagaagtaactaatactttgctagacgtccggnggacgggctatcacatcgcaagacactaactcagacanattgtatcgtacganaatgaacacgtagacgaccgaggacgtacggtntattattcttgcgngaggngttaggtggggttctaacgttcgggtcggttctttcgttgtaacgg

SEQ ID NO: 362166 - DNA, 765 bp, Homo sapiens
  misc_feature: GZ8MTXP01EFVDS.45.39.D06.1.454.CMB.2.raw
  modified_base (281)..(281): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctctttttaagaggtgtccagtgtcaggtggaagtggtgcgaggtccgggggaggcgtggtccagccgtgggacgtccctgacactctcctgtgaagcgcctggactcacctnagtggctagtcggccttcgacgtcggtcccgccgaggttccgaggcgaagggggctggagttggttgctgatatagtggtatggagtaggagaaagtaactaactacgtttgaccagtacgtccggtagggaccgggaccgtacttcctaccgactccggaccgaaacggaacgaaacgtaacgttacccgaacgggaaacctaacgttaacgtttggttaacgttccgtttaggaaccgtaaacgttaacgaaacccgtaacccgtaacggaaccggtaaaccccgggaacgggtaaccccggtaaggggttaacgtttaagtttaacgttttcggttccggtaccggtaccgggaaacgggttagggttaacgggggttttccggggggttttaacccgtttaaccggggtttttcgggggttttaccccgggggtttacccgtttttttaaccccgggttttaagggttttaacccggggg

SEQ ID NO: 362167 - DNA, 630 bp, Homo sapiens
  misc_feature: GZ8MTXP01C1BMN.45.39.D06.1.454.CMB.2.raw
  modified_base (308)..(308): a, c, t, g, unknown or other
  modified_base (464)..(464): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtcggggagagtggtccagccgtgggacgtccctgacactctcctgtgaagcgcctggactcacctcgagtggctatcggccttcgacgtcgggtccnccgtaggtccagggtcgaagggggctggaggttggtggctggatatagtggtatgaatggaacgaaagaactaacgtctttgactaggactcggtagacggggctattccgacatcgacgaagacgaacaactccgaaggaacacgtattgtactntaggactaatcgaaactaaccgtagacgtaaccccgagaacgtacgggtaagtaagttacgttcgagcggtacgttaaggttgggttacgggtttcgggggttaccttaaccgggtttcggggttacccgggtttaacctttttccggtttaaggttaacccgggg

SEQ ID NO: 362168 - DNA, 742 bp, Homo sapiens
  misc_feature: GZ8MTXP01BH5Z9.45.39.D06.1.454.CMB.2.raw
  modified_base (246)..(246): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagccgtgggacgtcccngacactctctgtgagcgcctggactcacctcgagtggctatcggtcccttcgacgttcgggtccccgccgtacggttccagggcgaaagggggctgggagtgggttggctgatagtatggtatggagtggaagtaaagaaccttaacgtactttgactacgaccgttcggtagggacggggccgtattaccgaacctacgtccgaccgaaggaacgtaacctaaacgttacccgaaaggtaaacctaacgtaacgtttaggttaacttccggttagggaacctaaacgttaacgaaacccgtaaaccgtacggaaaccggtaaccccggaagggtaacccgtaaccgggggttaattaacgtttacgtttaccgttcggtaccggaccgttaaggagggttacggggtttaacgggggtttacccgtttaaccgggttttcggggtttacccggggtttacccgttttttaaccggtttaacggttaacccggggg

SEQ ID NO: 362169 - DNA, 670 bp, Homo sapiens
  misc_feature: GZ8MTXP01C4ZCK.45.39.D06.1.454.CMB.2.raw
  modified_base (260)..(260): a, c, t, g, unknown or other
  modified_base (294)..(294): a, c, t, g, unknown or other
  modified_base (301)..(301): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttctttaagaggtgtccagtgtcaggtggagtggtgcgaggtccgggggagcgtggtccagccgtgggacgtccctgacactctcctgngaagcgctggactcacttcagtgctatggccttnctggccnctaggtccaggcgaggggctgggagtgggttggctgatagtagtggtatgatggaaagagaactaaactcgtttgacagacctcggtggacggggccgtattcaccacgtcgacgagagacaacttaccaaggaacactagttagtatcgtacggactaagtacggaaacctaaccgtacggtaaaccggaacccggaacgggtaaccggtaaccgggggttagttaacgtttaacgtttccggtacggtaccgggttaccgggagggttaggggttaaggggtttacgggggggtttcccgtttaaccggggtttcgggggttttacccgggggttttaacccgttttttcccgggtttttaacgggg

SEQ ID NO: 362170 - DNA, 742 bp, Homo sapiens
  misc_feature: GZ8MTXP01EJY4J.45.39.D06.1.454.CMB.2.raw
  modified_base (251)..(251): a, c, t, g, unknown or other
  modified_base (310)..(310): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacnctctccgtgtgaagcgcctggactcacctcagtggctatcggccttcacgtgggtcccnccgtaggtttccagggcgaaagggggtctagggacgttgggttggcttaggatagtagtggtatgagtggaagaaacgaacttaaactcgttttagacctacggtaaccgtccgggtagggacgggggtacccgtagttaccgaaccgtacgtcccgaccgaaacggaacggtaacctaaacgttacccgaaacgggaaacctaaccgtagtttaggggtaacttaccggttagggaacctaaacgttaaccgaaaaccgtaaaccgttacggaaaccggtaacccccggaagggtaaaccgtaccggggttaagttaacgttagtttcgacggtacggacgttaacggttgggttaacgggttcgggggttaccttaaccgggtttcgggttaccggggttaccctttttccggtttaagttaacccgggg

SEQ ID NO: 362171 - DNA, 803 bp, Homo sapiens
  misc_feature: GZ8MTXP01BU66E.45.39.D06.1.454.CMB.2.raw
  modified_base (281)..(281): a, c, t, g, unknown or other
  modified_base (308)..(308): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggaggcgtggtccagccgtgggacgtccctgacactctcctgtgaagcgcctggactcacctnagtggctatggccttcacgtgggtccnccgtaggttccaggcgaaggggtctggagttggttggctaggatagtagtcggtatgagtacggagaaacgtaaacctaaactcgtttacggacctaacggtacccgttaccgggtaggggaaccgggggtacccgtaacgtttacccgaacccgtaacgtaccggacccgtaaacggacggtaaacctaaaccgttacccgaaagggtaaaccctaacgttaagtttacggggttaacttacgttacgggaacctaaaacgttaaccggaaaacccgtaaccgtaacggaaaccggtaaaccccgggaaacgggtaccggtaaaccggggttaacgttaaagtttacgttttacccggaggttacccggaacgggttacgggttagggttacgggggtttaacgggggggtttacccgtttaacccggggttttcgggggtttacccgggggttttacccgttttttcccggttttaaacgggtttcccggggg

SEQ ID NO: 362172 - DNA, 638 bp, Homo sapiens
  misc_feature: GZ8MTXP01EBRJF.45.39.D06.1.454.CMB.2.raw
  modified_base (299)..(299): a, c, t, g, unknown or other
  modified_base (371)..(371): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagccgtgggagtccctgacactctcctgtgaagcgcctggactcaccttcagtggctatggcccttnacgtgggtcccgcctagggttccagggcaagggggctgggagtgggttgctgatatagtggtatgatggaanagaactaaactactttgacagtacgtccggtaggacgggccgattacgaccagtccgaccagaacgacaattccaaggaaacacgtagttgtatcgtaggacaaagtacgaactaacctcgaacggaaccccggaacggaaccgaacgggttacgttaagttacgtttacgtcgcggacggacggttagggtaacgggttcgggggtttaaccgttaccgggtttcgggggttacccggggttaaccgttttttccggtttaacggg

SEQ ID NO: 362173 - DNA, 624 bp, Homo sapiens
  misc_feature: GZ8MTXP01CG3JM.45.39.D06.1.454.CMB.2.raw
  modified_base (536)..(536): a, c, t, g, unknown or other
  modified_base (565)..(565): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggagcgtggtccaggccgtggggagtccctgacactctcctgtgagcgcctggactcaccttcagtggactagtcggtccttcacgtcgggtcccgccaggttcccgaggcgaagggggctgggaggtggttgctagatagtagtgggtatggatgggaaagtaagaactaaactcgtttagacagtaccgttcgggacggacggggtcctagttaccacgacgtcgaccgaagacgaactaacgttaccgaacggtaacactattagtatcgtacggactaatacgaactaacgtgaaccgaccgagcgtaaggtnttattcttagtcgcggttacgaggttagngggttacgggggttcgttacggtttcgggttaccgggttaaccgttttcgtttaacggg

SEQ ID NO: 362174 - DNA, 524 bp, Homo sapiens
  misc_feature: GZ8MTXP01AM45Y.45.39.D06.1.454.CMB.2.raw
  modified_base (303)..(303): a, c, t, g, unknown or other
  modified_base (339)..(339): a, c, t, g, unknown or other
  modified_base (354)..(354): a, c, t, g, unknown or other
  modified_base (363)..(363): a, c, t, g, unknown or other
  modified_base (375)..(375): a, c, t, g, unknown or other
  modified_base (387)..(387): a, c, t, g, unknown or other
  modified_base (395)..(395): a, c, t, g, unknown or other
  modified_base (461)..(461): a, c, t, g, unknown or other
  modified_base (479)..(479): a, c, t, g, unknown or other
  modified_base (481)..(481): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggaggtccctgacactctcctgtgagcgcctggactcacctcagtggctatggccttcactgggtcccncaggttccaggcaaggggctggagtggtggctgatntatggtatgatgganaagactaanttgcagactcgngagggcatcacntcgcaganacatccagaacactataggtatcgtggacaagtcgaacaacctgacgacccggaggacgacgggtntattattcttgcgcgagngnggtggggtctaacgttgggttcgggttacctttcgtttgtcgg

SEQ ID NO: 362175 - DNA, 770 bp, Homo sapiens
  misc_feature: GZ8MTXP01BMWW5.45.39.D06.1.454.CMB.2.raw
  modified_base (308)..(308): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctctgtgagcgctggctcacttcagtgctatcggccttcacgtcgggtcccncctagggttcccagggcgaaggggggtctggggacggttgggttggcttaggattagttagtggggttaatggaacgtgggaaaagtaactaaccttaaaacgtcttttggacctaggtaccgttccgggtagggacgggggtcctaacttacccggaacctacgtcccggaaccaacggtaacgaaccgtaaccgttacccgaaacgggtaaacctaaccgttaaggtttcgttaaacgtccgttacgggaacctaaacgttacgaaaacccgtaaacccgttaggaaacccgggaaccccggaagggtaaccggtaacccggggtttagttaaccgttagttttaccgcggtccgggttacggacgggttaagggtcggggttacggggggtttaaccccgttacggggtttccgggggtttacccggggttttaacccgttttttccggtttaacgggg

SEQ ID NO: 362176 - DNA, 641 bp, Homo sapiens
  misc_feature: GZ8MTXP01C943D.45.39.D06.1.454.CMB.2.raw
  modified_base (184)..(184): a, c, t, g, unknown or other
  modified_base (253)..(253): a, c, t, g, unknown or other
  modified_base (279)..(279): a, c, t, g, unknown or other
  modified_base (304)..(304): a, c, t, g, unknown or other
  modified_base (557)..(557): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggtttttcctcgttgcttcttttaagnggtgtccagtgtcaggtggagtggtgcagggtccgggggagcgtggtccagccgtgggagtccctgacnctctctgtgagcgctggactcacttnagtgctatcgccttcacgtggtccncgaggttccaggcgaagggggctgggagtggttgctgatatagtggtatgatggaaatagtaactaaactcgtttaggacaagtacgtcggtaggacgggcgtactcaccagtaccgaccgaagacgaactaaacttaccgaaggtaaaccactaagtttacggtaatccgtaggactaaagtacgaaactaaccgtgaacgacccggacggaacgtaacggggtattacgttacgttcgtacggcggacggnggttagggtaacgggtttcgggggtttaacctttacgggtttcgggggtttaccggggtttaacccgtttttccggtttaaggg

SEQ ID NO: 362177 - DNA, 589 bp, Homo sapiens
  misc_feature: GZ8MTXP01EFFBW.45.39.D06.1.454.CMB.2.raw
  modified_base (518)..(518): a, c, t, g, unknown or other
  modified_base (536)..(536): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagccgtgggacgtccctgacactctcctgtgaagcgcctggactcaccttcagtggctagtcggcccttcgacgtcgggtcccgccgtaggttccccgaggcgaagggggctgggagttgggtgctgattagtagtggtatgagtcggaaagagaactaaactactttgacagtacgtcggtggacggggccgtattcgaccagtcgaccgaagagacaacgttaccgaaggaacactagttgtatcgtggacaatcgaacaacgtgaacgaccgagcgaacggtnttatacttgtcgcgacgngaggtaaggttggggttctacggttcgggttcggttaaccgttttcgttaagg

SEQ ID NO: 362178 - DNA, 584 bp, Homo sapiens
  misc_feature: GZ8MTXP01DLAH3.45.39.D06.1.454.CMB.2.raw
  modified_base (279)..(279): a, c, t, g, unknown or other
  modified_base (296)..(296): a, c, t, g, unknown or other
  modified_base (520)..(520): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggagtggtgcgaggtccgggggagcgtggtccagccgtgggacgtccctgacactctctgtgagcgctggactcaccttnagtgctagtcggccttnacgtcgggtccgcctaggttccccaggcgaagggggctgggagtggttggctagatagtagtggtatgatggaagaagaactaaacgtcttgacagactcggagagggcatcacatcgacagacacatcaagaacactagttgtatcgtggaactaagacgaacaaccgtgaaccgtaacccggaggaacgtaacggggtattattacgttcgtcggcgacggnggacggtaagggttcgggggtcctttacgggttcgggttaccgggtttcccttttcgttaacgg

SEQ ID NO: 362179 - DNA, 595 bp, Homo sapiens
  misc_feature: GZ8MTXP01DL6JH.45.39.D06.1.454.CMB.2.raw
  modified_base (374)..(374): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgaggtccgggggagcgtggtccagcctgggagtccctgacactctctgtgagcgctggactcaccttcagtggctagtcggtcccttcacgtcgggtcccgccgaggttcccgaggcgaaagggggctgggagtgggtgctgatatatggtatgagtggaaganaactaaactctttgacagactcggtggacgggcctatcacatcgacagagacataccagaacactagttgtatcgtagacaagtcgaacaacctgaacgacccggaacggacgtaacgggtagttattcgttacgtggcgacggttgttaacgggtaagggttcgggggttccgttaccgggttcggggtttaccggggttcccgtttttcgtttaacggg

SEQ ID NO: 362180 - DNA, 589 bp, Homo sapiens
  misc_feature: GZ8MTXP01BCS3T.45.39.D06.1.454.CMB.2.raw
  modified_base (253)..(253): a, c, t, g, unknown or other
  modified_base (261)..(261): a, c, t, g, unknown or other
  modified_base (307)..(307): a, c, t, g, unknown or other
  modified_base (409)..(409): a, c, t, g, unknown or other
  modified_base (417)..(417): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtccgggggagcgtggtccagccgtgggacgtccctgacnctctctgngagcgctggactcacctcagtggctatggccttcacgtcgggtccnccgtaggttccaggcgaagggctgggagtcggtgctgatagtacgtggtatgagtggaagataactaaacatttcgacagctcggtggacggcgatcacacncgacaganacactacgagaacacagttgtatcgtgactaagtacaacacgtcgaacgaacccggacggacggtaacgggtgttattacgttcgtcggcggttcgaggttacggtaagggttcgggggttaacttacgggttcgggttaccggggtttaaccgtttttcccggtttaaggg

SEQ ID NO: 362181 - DNA, 616 bp, Homo sapiens
  misc_feature: GZ8MTXP01BO3QW.45.39.D06.1.454.CMB.2.raw
  modified_base (181)..(181): a, c, t, g, unknown or other
  modified_base (308)..(308): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcgtggtttcgcgttaggctctttaagaggtntcagtgtcaggtggaagtggtgcgaggtccggggagcgtggtccagccgtgggacgtccctgacacgtctctgtgagcgcctggactctacctgagtggtactgtcggtccttacgcgtcggtaccncgtacggttccgaggcgtaagggggctgggagtggttgcttgatatagtcgtatgagtacggataacgaactaactcttgcaacgtccgttcggaggacgggcctattccgaccagtcgaccacgaacgacgtactacgacgaacgtactacgttacgtagtcgtacgacgaacgtaacgaacgaacgtacgacgtacgacggtacgtacggtaacgtagttacgtcgttcgtacgtacggacggttcggttacgggttcgggttcggttcggtttcgggttacggttaccgtttaacgtttcgtcgg

SEQ ID NO: 362182 - DNA, 594 bp, Homo sapiens
  misc_feature: GZ8MTXP01CW9M2.45.39.D06.1.454.CMB.2.raw
  modified_base (181)..(181): a, c, t, g, unknown or other
  modified_base (251)..(251): a, c, t, g, unknown or other
  modified_base (278)..(278): a, c, t, g, unknown or other
  modified_base (311)..(311): a, c, t, g, unknown or other
  modified_base (386)..(386): a, c, t, g, unknown or other
  modified_base (399)..(399): a, c, t, g, unknown or other
  modified_base (414)..(415): a, c, t, g, unknown or other
  modified_base (489)..(489): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagtcttgggttttcctcgttgcttcttttaagnggtgtccagtgtcaggtggaagtggtgcgaggtccgggggagcgtggtcagccgtgggacgtccctgacnctctctgtgagcgcctggactcacctnagtggctagtcggccttcgacgtcgggtccccnccgtaggttccagggcgaagggggctgggagtttggtggcttgatatagtggtatgatggagaaagtactaactnttgacagcctcgnggacgggctatcacnncgcagacacatcgagaacactattgtatcgtgacagtagaaccacgtagaacgtacccggaggaccgtagggtntaagttacgttcgttgacggtgacggaggttacgggttaacgggggttccttaaccgggtttcgggttacccgggtttacctttttaacgtttcgttaaccgggg

SEQ ID NO: 362183 - DNA, 608 bp, Homo sapiens
  misc_feature: GZ8MTXP01EESKZ.45.39.D06.1.454.CMB.2.raw
  modified_base (303)..(303): a, c, t, g, unknown or other
  modified_base (343)..(343): a, c, t, g, unknown or other
  modified_base (348)..(348): a, c, t, g, unknown or other
  modified_base (356)..(356): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcagggtggaagtggtgcgaggtccggggggagcgtggtccagccgtggggacgtccctgactactctcctgtgaagcgcctggactcaccttcagtggctatggccttnactgggtccgcaggttccaggcaaggggctggagtggtgntgatntatggtangatggaaagagaactaaatctttagctagactccgggtaggaggggccgatcacactcgacagaagacaattaccgaaggaacactagttgtattctcgggacaaagtcgaaacaaccgtacgacgacccggaacggacgtaacgggtattagttactttacgtcgacggacgttaggaggtaacgggtacgggggtttcgttacccggtttcggggtttaccggggttaacccgttttttccgtttaaggg

SEQ ID NO: 362184 - DNA, 652 bp, Homo sapiens
  misc_feature: GZ8MTXP01AN77R.45.39.D06.1.454.CMB.2.raw
  modified_base (253)..(253): a, c, t, g, unknown or other
  modified_base (261)..(261): a, c, t, g, unknown or other
  modified_base (280)..(280): a, c, t, g, unknown or other
  modified_base (311)..(311): a, c, t, g, unknown or other
  modified_base (592)..(592): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagcctgggacgtccctgacnctctctgngagcgctggactcaccttnagtggctagtcggccttcacgtcgggtcccnccgtagggttcccagggcgaagggggtctagggacggttgggttcggctggattacgtagtggtatggatggaagagaactaaactactttgacagtactccgggtagggacggggtaccgtacgttacaccgtaacgtccgacccgaagaacggaacctaaacttacccgaacgggaaacctaactaggtttacgtaacgttcgtacggacaagtacgaaaccaaccgtacgaacgacccggaggaacgtaacgggtgttatacgtttcgcggtcgaggnggacggtaagggtcggggttccttacggttgggttaccgggttccgttttccgtttaagg

SEQ ID NO: 362185 - DNA, 666 bp, Homo sapiens
  misc_feature: GZ8MTXP01AWZPR.45.39.D06.1.454.CMB.2.raw
  modified_base (250)..(250): a, c, t, g, unknown or other
  modified_base (315)..(315): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctgttgcttctttttaagaggtgtccagtgtcaggtggaagtggtgcgaggtccgggggagcgtggtccagccgtgggacgtcccngacactctctgtgagcgcctggacctcaccttcagtcggctagtcggccttcacgtcgggtcccnccgaggtttcccgaggaccgaagggggccttagggacggtggttgcttggaattagtagtcggtatgtagtgggaaacaagtaactaaacgtctttacggactacgacgtaccgggtagggaaccgggggtacctattacccgaaccgtacgttccgacccgaaggaagtaaccctaaacgttacccgaaacggaaaccaagttaattacgggtaattccgaggacctaaagtaacgaaccgtaaccgtacgtaacgaaccgaacggacgtaaccggtagttagtacttcgtcgcgcgcgaggtggtcgggttcgttacgttcgggttacgggttccgtttcgtttaacgg

SEQ ID NO: 362186 - DNA, 692 bp, Homo sapiens
  misc_feature: GZ8MTXP01AXME5.45.39.D06.1.454.CMB.2.raw
  modified_base (302)..(302): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtccgggggagcgtggtccaggcctgggacgtccctgacactctctgtgagcgctggactcacctcagtggctatggccttcactgggtccncaggttccaggcaagggggctggagtggttggcttgatagtagtggtatggatggagaagaacttaactctttggacaaggtaccgtccggtagggacggggtacccgtaacttaccgaaccgtacgtacccggaccgaaacggaacggaacctaaacgttaccccgaaagggtaaacccaacgtaacttaggggtaacttcgtacggtacaaacgtacggaaaccaaacccgttaggaaaccgtaacccggaaggaccgtaacgggtaacgttaattacgttacgttcggacggtaccgaacggttaggttacgggttaacggggggttaccttaaccggtttgggggtttaccgggttaccttttaaccggtttaaggttaaccgggg

SEQ ID NO: 362187 - DNA, 802 bp, Homo sapiens
  misc_feature: GZ8MTXP01B1HH5.45.39.D06.1.454.CMB.2.raw
  modified_base (284)..(284): a, c, t, g, unknown or other
  modified_base (289)..(289): a, c, t, g, unknown or other
  modified_base (318)..(318): a, c, t, g, unknown or other
  modified_base (412)..(412): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagagactcaccatggagttgggctgagcttgggttttcctcgttgcttcttttaaggaggtgtccagtgtcaggtggaagtggtgcgaggtccgggggagcgtggtcccaggccgtggggacgtccctgtaccactctccgtgtagaacgcgctggctcnccttnagtgctatcggccttcacgtcgggtcccncgtacggttccgaggtacgaacgggggtcctaggggaggttcggttggacgttagtaagtactacggttaggtagtaggtacgttggggaaaanaacgtaacttaaaaccgtcgttttaggaccgttaaggaccgttaccggggtacgggaacggggtacccgtaacgtttaccgaacccgtagtacccggaacccgttaagggaaaccgtaacgtaaaccgttaccgaaacgggtaaacctacccggtttaagggtaacgttacggtaaccgttacgggaaactaaaccggtaacgtaaacccgtaaccgtaccggaaacccggtacccgggtaaacggtaacccgggtaagtttaacgttaaacgttcgttaccgtacgggtaccgttacgggttaccggagggttaaccggggttacggggttccgtttaacggggttccggggtttacccggtttaacccgtttttaacggtttccgggg

SEQ ID NO: 362188 - DNA, 802 bp, Homo sapiens
  misc_feature: GZ8MTXP01CFF1O.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttctttttaagaggtgtccagtgtcaggtggaagtggtgcgaggtccgggggagcgtggtccagccgtgggacgtccctgacactctcctgtgagcgcctggacctcacctcaggtgctatcggcccttcacgtcgggtcccgccgtacggtttcccgaggggtccgaaggggggtccttagggggacgggtttggggtttgggaccgttaggtaagttaagttaggttgggttaattaggtaacgttagggggaacgtaaaacgggtaaacccttaaacgtcgtttttacgaccgtaacggacccgttccggggtagggacgggggtacccgtaagtttccccgaaccgacgttcccggaccgaacggtaaacgtaaccgtaaaccgttacccggaaacggaaacctacgttatttacgggttacttacggttacggaaccgtaaattaccgaaaccgtaaaccgtacggaaccgtaaaccccgggaaggtaacccggtaagggggtaactttaagtttatttccgttacggtacgggcggaaggttagggttacggggtttcgggggttaccgtttaaccggtttcgggggtttccggggtttaccctttttccggtttaaggttcggggg

SEQ ID NO: 362189 - DNA, 582 bp, Homo sapiens
  misc_feature: GZ8MTXP01BJ8EV.45.39.D06.1.454.CMB.2.raw
  modified_base (337)..(337): a, c, t, g, unknown or other
  modified_base (412)..(412): a, c, t, g, unknown or other
  modified_base (490)..(490): a, c, t, g, unknown or other
  modified_base (496)..(496): a, c, t, g, unknown or other
  modified_base (502)..(502): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctggggagtccctgacactctcctgtgagcgcctggactcacctcagtggctatggccttcactggggtcccgccaggttccagggcaagggggctggagtggtggntgatatagtggtatgatggagaagactaagctttgcagactccgtgacggggcctattcaccatacgcaaggtanactaagttccaaggtaacactagttaggtatcgtcggaccaagtacgtaacaaccgtgaacgcccgaggacacgggtntagttnttccgngtcccgagttcggaggttacgttgggggttacgttaaccgtttggggttccgggttaccgttttcgttttggtaaccggg

SEQ ID NO: 362190 - DNA, 604 bp, Homo sapiens
  misc_feature: GZ8MTXP02GV00C.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcgtggtttcgcgtaggctctttaagaggtgtccagtgtcaggtggaagtggtgcagtccgggggagcgtggtccagcctggggaggtccctgacactctcctgtgaagcgcctggacctcactcagtggctatggccttcctcgtcggtccgccgacgtcgaggacgagggcgtggtaggtggtggtcgtgtagtagtagtgtagtagtagtaggagaagaactaactacgttagtacgacgtacgtacgtacggacggggaccgtacgtaccgtaccgacgtccgaccgacgaacgaactaacgtaccgaacgaacgaactattagtatacgtagacgaataacgaaacgaacgtacgacgaaccgaacgacgacggtacgtagttattacgtacgcgacgagagaggtgggtcgttacgttacggttcggttaccgtttacgtttacgtcgg

SEQ ID NO: 362191 - DNA, 531 bp, Homo sapiens
  misc_feature: GZ8MTXP02GLPPT.45.39.D06.1.454.CMB.2.raw
  modified_base (303)..(303): a, c, t, g, unknown or other
  modified_base (364)..(364): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccnccaggttccaggcaaggggctggagtggtggctgatatatggtatgatggagagactaacnctttgcagactccgtgagggcgagttcacatcgccagagacaattccgggaacacattgtatctggcaatgaacaacctgagacccgaggacgacgggtgtatatttctgcgcgagagagtgggggttctacgttggttcggggtacctttcgtttacgtggtacgg

SEQ ID NO: 362192 - DNA, 517 bp, Homo sapiens
  misc_feature: GZ8MTXP02IESS8.45.39.D06.1.454.CMB.2.raw
  modified_base (341)..(341): a, c, t, g, unknown or other
  modified_base (366)..(366): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggtttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccgccaggttccaggcaaggggctggagtggtggctgatntatggtatgatggagagactaaacnctttgcagactcgtgagggcgatcacatcgcagagacaatccaggaacacattgtatctggacaatgaacactagacgaccgagacacggtagtagtattcgtgcgcgagagaagtgggggttactacgttggtcgggtactttcgtttag

SEQ ID NO: 362193 - DNA, 559 bp, Homo sapiens
  misc_feature: GZ8MTXP02HUSP5.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagcctgggaggtccctgacactctcctgtgagcgcctggactcaccttcagtggctagtggccttcacgttgggtccccgcctaggttccagggcaaggggctgggagttggttggctggatagtagtggtatgatggagagaactaactactttgcagtacctccggtgacggggccgtatccacatccgccagacgaacaataccagaacactattgtatcgtggacaatagaaacaacctagaacgacccgaggacgacgggtcgtattattctgcgcgagagtaggtggggttctacggttcgggtacggtcctttcgttagtcgg

SEQ ID NO: 362194 - DNA, 526 bp, Homo sapiens
  misc_feature: GZ8MTXP02GOOEH.45.39.D06.1.454.CMB.2.raw
  modified_base (360)..(360): a, c, t, g, unknown or other
  modified_base (370)..(370): a, c, t, g, unknown or other
  modified_base (479)..(479): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccgccaggttcccaggcaaggggctgggagtggttggctgatatatggtatgatgganagactaaacnctttgcagactcgtgagggccgatcacatcgcagagacaattccaggaacacattgtatctggacaatagaacaacctgacgaccgaggacgacgggtagtatacttcngcgcgagagaagtgggggtctacgttggttcggtacgtttcgtttag

SEQ ID NO: 362195 - DNA, 535 bp, Homo sapiens
  misc_feature: GZ8MTXP02HVPVB.45.39.D06.1.454.CMB.2.raw
  modified_base (377)..(377): a, c, t, g, unknown or other
  modified_base (411)..(411): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggacgtccctgacactctcctgtgagcgcctggactcaccttcagtggctatcggccttcacgtcgggtccaccgtaggttcccaggcgaaggggctgggagtggttggctgatatatgtatgatggagagactaaacncttgctagctcgtgagggcatcacatcgacaganacatcagacacattgtatcgtagacaagtacgaacacgtagacgaccgagacgacggtgtatacttctgcgcgagagtaaggttcggggttacgttacggtggtttccggtacttttcgttacg

SEQ ID NO: 362196 - DNA, 542 bp, Homo sapiens
  misc_feature: GZ8MTXP02JD3LJ.45.39.D06.1.454.CMB.2.raw
  modified_base (373)..(373): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggaggtccctgacactctcctgtgaagcgcctggactcaccttcagtggctatggccttcacgtgggtccgccaggttccaggcgaaggggctgggagtggtggctgatatatggtatgatggagagactaaacncttgcagactccgtgagggcgatcacatcgcagagacaataccagaacacattagtatctggacaatagaacaactagacgaccgagacgacgggtagtatacgttctagtcgacgagagaaggtcgggggttactacgttcggttacgggttaccgtttcgtttacgg

SEQ ID NO: 362197 - DNA, 574 bp, Homo sapiens
  misc_feature: GZ8MTXP02GO7UP.45.39.D06.1.454.CMB.2.raw
  modified_base (306)..(306): a, c, t, g, unknown or other
  modified_base (361)..(361): a, c, t, g, unknown or other
  modified_base (369)..(369): a, c, t, g, unknown or other
  modified_base (530)..(530): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccggggagcgtggtccagccgtgggaggtccctgacactctcctgtgaagcgcctggactcaccttcagtggctatcggccttcactgggtcccnccgtaggttcccaggccaaggggctggagtggtgctgatatatggtatgatgganagactacntttgcagacctcggtggacggggccgagttccaccgtatccgacccgagacgaactaaacttacccgaaaggaaacaacgtaatttagtaattcgtaggactaatacgaaaccaaccgtagaacgaccgaagacgacgggtagtatattctagcgacgagngtaggtggggttactcgttacggtcggttactttcgttagtcgg

SEQ ID NO: 362198 - DNA, 590 bp, Homo sapiens
  misc_feature: GZ8MTXP02FWD26.45.39.D06.1.454.CMB.2.raw
  modified_base (303)..(303): a, c, t, g, unknown or other
  modified_base (367)..(367): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctctgtgaagcgcctggactcaccttcagtggctatcggccttcacgtgggtccnccgtaggttcccaggcgaaggggctggagtggtggctgatatatgtatgatggagagactaacnttgcagacgtcgtgggacgggcgattcacactcgccagacgaacaacttaccgaagaacaactattgtaatcgtaggactaaatacgaaacactagaaacgacccggaagacgacgggtagtattaagtttccgtgacggcgaacggtaggaggttcgggggttaccgtaacggtttcgggggttaccgggtttaacccgttttccgttttaacggtccgggg

SEQ ID NO: 362199 - DNA, 530 bp, Homo sapiens
  misc_feature: GZ8MTXP02JZK6I.45.39.D06.1.454.CMB.2.raw
  modified_base (307)..(307): a, c, t, g, unknown or other
  modified_base (361)..(361): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggaggtccctgacactctcctgtgaagcgcctggactcaccttcagtggctatggccttcactgggtccnccaggttccaggcaaggggctgggagtggttggctgatatatggtatgatgganagactaaacactttgcagactccggtgaggggccgattcgaccatcgccagagacaattccaggaacacattgtatctggcaatgaacaactgagacccgaggacacgggtgatattctgcgcgagagaagtgggggttctacgttggttcgggtacctttccgtttag

SEQ ID NO: 362200 - DNA, 514 bp, Homo sapiens
  misc_feature: GZ8MTXP02HLE03.45.39.D06.1.454.CMB.2.raw
  modified_base (369)..(369): a, c, t, g, unknown or other
  modified_base (421)..(421): a, c, t, g, unknown or other
  modified_base (463)..(463): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccgccaggttcccaggcaaggggctgggagtggttggctgatatatggtatgatggagagactaaanctttgcagactcgtgagggcatcacatcgcagagacatcagaacacatgtanctgcaatgaacactgacgaccgagacacggtgtatacttacngcgcgagagaagtgggggtctacgttggttcgggtaccttttacgtttacg

SEQ ID NO: 362201 - DNA, 537 bp, Homo sapiens
  misc_feature: GZ8MTXP02JJS2Z.45.39.D06.1.454.CMB.2.raw
  modified_base (427)..(427): a, c, t, g, unknown or other
  modified_base (432)..(432): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggtttcctcgttgctcttttaagaggtgtccagtgtcaggtggaagtggtgcaggtccgggggaggcgtggtccagcctgggaggtccctgacactctcctgtgaagcgcctggactcaccttcagtggctatggccttcactgggtccgccacggttccaggcaaggggctgggagtggttggctgatatatggtatgatggagagactaaacactttgacagactccgtgacgggcgatcacatcgccagagacaatacagaacacatntatcngtacaatgaacaacctagacgaccgagacgacggtgtatacgttactcgtcgcgagagtaaggtgggggttcgtacggttggttcgggtaccgtttcgtttacgg

SEQ ID NO: 362202 - DNA, 531 bp, Homo sapiens
  misc_feature: GZ8MTXP02IW78M.45.39.D06.1.454.CMB.2.raw
  modified_base (303)..(303): a, c, t, g, unknown or other
  modified_base (362)..(362): a, c, t, g, unknown or other
  modified_base (488)..(488): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggaggcgtggtccagcctgggaggtccctgacactctcctgtgaagcgcctggactcaccttcagtggctatggccttcactgggtccncaggttccaggcaaggggctggagtggttgctgatatatggtatgatggagagactaanctttgcagacctcggtggacggggcgagttcaccatcgccagacgacaacttaccaggaacacattgtatctggcaatacgaacaactgaacgaccgaggacgacgggtgtatattctgcgcgagngagtgggggttctacgttggttcgggtactttcgttacttcgg

SEQ ID NO: 362203 - DNA, 559 bp, Homo sapiens
  misc_feature: GZ8MTXP02GYSQI.45.39.D06.1.454.CMB.2.raw
  modified_base (376)..(376): a, c, t, g, unknown or other
  modified_base (390)..(390): a, c, t, g, unknown or other
  modified_base (413)..(413): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggaggcgtggtccagccgtggggacgtccctgacactctcctgtgaagcgcctggactcaccttcagtggctatggccttcacgtgggtccgccaggttcccaggcaaggggctgggagtggtggctgatatagtggtatgatggagagactaaacnctttgcagactcgnggaggggcgatcacatcgcaganacaatcgagaacacattgtatctggacaatagaacaactgacgacccgagacgacgggtagtatacgttcgcgtcgacgaggaggtaaggttcgggggttaccgttacggttcgggtttaccggggttaccgttttacgtttacgg

SEQ ID NO: 362204 - DNA, 532 bp, Homo sapiens
  misc_feature: GZ8MTXP02GT2OI.45.39.D06.1.454.CMB.2.raw
  modified_base (306)..(306): a, c, t, g, unknown or other
  modified_base (372)..(372): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctatggccttcactgggtccnccaggttcccaggcaaggggctgggagtggttggctgatatatggtatgatggagagactaaaacnctttgcagactccgtgaggggcatcacatcgcagagacaatccagaacacatgtatctggcaatgaacaacctgacgacccgaggacaacgggtgtagtacttcgtgccgcgagagaagtgggggttctacgttgggttcggggtaccttttccgtttag

SEQ ID NO: 362205 - DNA, 585 bp, Homo sapiens
  misc_feature: GZ8MTXP02FK1DO.45.39.D06.1.454.CMB.2.raw
  modified_base (294)..(294): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagagtgtccagtgtcaggtgaagtggtgcgaggtccgggggagcgtggtccagccgtgggagtccctgacactctcctgtgaagcgctggactcacttcagtggctatggccttcncgtgggtcccgccgaggttccaggcgaagggctgggagtgggttgctgatatagtggtatgagtggagagtactaaactcttgacagaccgtccggtaggacggggcctattaccaccacgtccgaccagacgacaattaccaggaacactattagtatacgtggacaagtacgaaccaacgtagaccgacccgagacgtacggtagttatactttcgcgacgtacgaggtaggtggttacgggggttacttaccggttgggtttaccgggttaccttttccgtttaacgg

SEQ ID NO: 362206 - DNA, 536 bp, Homo sapiens
  misc_feature: GZ8MTXP02IF3WA.45.39.D06.1.454.CMB.2.raw
  modified_base (289)..(289): a, c, t, g, unknown or other
  modified_base (367)..(367): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctanggccttcactgggtccgctaggtccaggcaaggggctgggagtggtggctgatatatggtatgatggagagactaaanactttgacagactcgtgacgggcgattcacatcgcagagacaactcagaacacattgtatctggacaatagaacaacgtgacgaccgaggactacggggtatattattcgtgcgacgtagaggtaagtgggggttactacgtttcgggtcgggttacctttctttacgg

SEQ ID NO: 362207 - DNA, 563 bp, Homo sapiens
  misc_feature: GZ8MTXP02GVB9P.45.39.D06.1.454.CMB.2.raw
  modified_base (308)..(308): a, c, t, g, unknown or other
  modified_base (362)..(362): a, c, t, g, unknown or other
tcagacgcgatcgacacgaccggtgctcgatttagtgacatctcgcagttctttgggggctctgggagaggagcccagcactagaagtcgtcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtggggacgtccctgacactctcctgtgaagcgcctggactcaccttcagtgctatggccttcacgtgggtccnccaggttccaggcgaaggggctgggagtggttgctgatatagtgtatgatgganagactaaactacttgacagactccgtaggagggcgatcacatcgacagagacaactacaaggaaacactattagtatcgtaggacaatagaaacaacgtagacgaccgacggaacgtacgggtatattacgttcgtcgccgacgagaggtaaggtcgggggttacttacggttcgggttccggttacctttacgtttacgg

SEQ ID NO: 362208 - DNA, 522 bp, Homo sapiens
  misc_feature: GZ8MTXP02I0NHH.45.39.D06.1.454.CMB.2.raw
  modified_base (369)..(369): a, c, t, g, unknown or other
  modified_base (475)..(475): a, c, t, g, unknown or other
  modified_base (483)..(483): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggagtccctgacactctcctgtgaagcgcctggactcaccttcagtggctatggccttcactgggtccgccaggttccaggcaaggggctgggagtgggttggctgatatatggtatgatggagagactaaacnctttgcagactccggtgaggggcgattcacatcgcagagacaatcagacacattgtatctggacaagtgaacaactgacgaccgaggacgacgggtgtatacttcngtcgacgngagaagtggggtctacgttggttcgggtctttcgtttag

SEQ ID NO: 362209 - DNA, 532 bp, Homo sapiens
  misc_feature: GZ8MTXP02JECJJ.45.39.D06.1.454.CMB.2.raw
  modified_base (306)..(306): a, c, t, g, unknown or other
  modified_base (371)..(371): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgaccactctcctgtgaagcgctggactcaccttcagtgctatggccttcacgtgggtccnccaggttcccaggcaaggggctggagtggttggctgatatatggtatgatggagagactaaacgntttgcagacgtccgtgagggcgagtcacatcgcacgagacataccgagaacacatagtatactggacaagtacgaacaacctagacgacccgagacgacggtagtatacttctcgcgacgagagaagtggggtactacgtggttacggtactttctttagg

SEQ ID NO: 362210 - DNA, 523 bp, Homo sapiens
  misc_feature: GZ8MTXP02GPTJQ.45.39.D06.1.454.CMB.2.raw
  modified_base (355)..(355): a, c, t, g, unknown or other
  modified_base (392)..(392): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccgccaggttccaggcaaggggctggagtggttggctgatatatggtatgatgganagactacactttgctagactcgtgagggcgatcacancgccagagacaatccagaacacattgtatctggacaatgaacaactgacgaccgaggacacgggtagtatatttctgacgcgagagagtgggggttctacgttcggtcggtaccgtttcgttacgttacgg

SEQ ID NO: 362211 - DNA, 776 bp, Homo sapiens
  misc_feature: GZ8MTXP02GZG4Q.45.39.D06.1.454.CMB.2.raw
  modified_base (309)..(309): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccaggccgtgggaggtccctgacactctcctgtgaagcgcctggactcaccttcagtggctatggccttcacgtgggtcccnccgtaggttcccgaggcgaaggggctgggagttgggtgcgtagatagtagtggtatgatggagagaactaacgtactttgaccgtagtaccgtcccgggtaggacgggggccgtaacgttaccaaccgtacgtaccggacccgaaacggaacgaaacctaaacgttacccgaaaacggggaaacctaaccgtaaagtttacgttaacgttaccgttaacgggaaccttaaaacgttaaccggaaaacctaaaccccggttaacggaaacccgggaaaccccgggtaaacgggaaaccgggtaaaccgggggtttaacgttaaacgtttacgtttaccggttacggaaccggtaccgggaacggaggttaacggggttaacggggggttttaccgtttaacccgggtttacgggggtttacccggggtttaaccccgtttttaccggtttaaacgggtttcccggggg

SEQ ID NO: 362212 - DNA, 536 bp, Homo sapiens
  misc_feature: GZ8MTXP02HZKFV.45.39.D06.1.454.CMB.2.raw
  modified_base (248)..(248): a, c, t, g, unknown or other
  modified_base (428)..(428): a, c, t, g, unknown or other
  modified_base (432)..(432): a, c, t, g, unknown or other
  modified_base (435)..(435): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggaggcgtggtccagcctgggagtccctgacnctctcctgtgaagcgcctggactcaccttcagtggctatcggccttcacgtgggtcccgccaggttcccaggcaaggggctggagtggttggctgatatatggtatgatggagagactaactctttgacagactcgtggacggggccatcacatcgccagagacaatccagaacacattntatnganatagaacaactagacgaccgagacacgggtgtattagttctagcgcgtagagtaggtggggttactacgttcggttaccgggtacttttccgtttagtcgg

SEQ ID NO: 362213 - DNA, 564 bp, Homo sapiens
  misc_feature: GZ8MTXP02GTERY.45.39.D06.1.454.CMB.2.raw
  modified_base (306)..(306): a, c, t, g, unknown or other
  modified_base (371)..(371): a, c, t, g, unknown or other
  modified_base (432)..(432): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagcctgggagtccctgacactctcctgtgaagcgctggactcaccttcagtgctatggccttcacgtgggtcccnccaggttccaggcgaaggggctgggagtggttggctgatatagtgtatgatggagagactaaacntttgcagacgtccgtaggagggccgattcaccatcgacagacgacatacagaaacacattntatcgtaggacaaagtagaaacaacgtacgacgaccgaggacgacggtagtaatacttcgtcgcgacgagagaaggttacgggggttaccgttacggttcgggtttaccgggttaccgttttacgtttacgg

SEQ ID NO: 362214 - DNA, 642 bp, Homo sapiens
  misc_feature: GZ8MTXP02GFZ9A.45.39.D06.1.454.CMB.2.raw
  modified_base (181)..(181): a, c, t, g, unknown or other
  modified_base (380)..(380): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtggaagtggtgcaggtccgggggaggcgtggtccagcctgggaggtccctgacactctcctgtgaagcgcctggactcaccttcagtggctagtggccttcacgtcggggtccgccgtaggttccaggcgaaggggctgggagtggttggctgatatagtggtatgatggacgagactaaacnctttgactacgacgtcggtaggacggggccgtacgttcaccacgtccgaccagacgaacaattaccaaggaaacactattagttactctaggacaagtacgtaaacaacctaggaacgaacccggaaggaaccgtaacggggttagtaagttacgtttacgtcggacggtacggaaggagggtaacgggtttcggggggtttaccgtttaccgggtttcggggttttacccgggggttaaccgttttttccggttttacggg

SEQ ID NO: 362215 - DNA, 584 bp, Homo sapiens
  misc_feature: GZ8MTXP02JWHV0.45.39.D06.1.454.CMB.2.raw
  modified_base (294)..(294): a, c, t, g, unknown or other
  modified_base (305)..(305): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggaggtccctgacactctcctgtgaagcgcctggactcaccttcagtggctatggccttnactgggtcccnccgtaggttccaggcgaaggggctggagtggttggctgatagtatggtatgatggagagactaacgactttgacagacctcggtggacggggccgtattcgaccagtcgcccgagacgaactaacgttaccacggaaacacaattacgtactctaggacaagtacgaaacaacctagaacgaccgagaccgaagggtcgtaatagttctggacgacgacgagaggttcgggggtcttacggttcgggttacggggttaccttttcgttacgtttacggg

SEQ ID NO: 362216 - DNA, 520 bp, Homo sapiens
  misc_feature: GZ8MTXP02FJU95.45.39.D06.1.454.CMB.2.raw
  modified_base (163)..(163): a, c, t, g, unknown or other
  modified_base (305)..(305): a, c, t, g, unknown or other
  modified_base (364)..(364): a, c, t, g, unknown or other
  modified_base (483)..(483): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcgtgggttttccncgttgctcttttaagaggtgtccagtgtcaggtggaagtggtgcaggtccgggggaggcgtggtccagcctggggagtccctgacactctcctgtgaagcgcctggactcaccttcagtggctatggccttcactgggtccncaggttccaggcaaggggctggagtggtggctgatatatggtatgatggagagactaanctttgacagactcggtgacggggccgagttcaccatcgccagacgacaatccagacacatgtatcgtgacaatagaacaactagacgacccgagacgacggtgtatattctgcgcgagngagtggggtctacgtggtcggtactttcgttagtcgg

SEQ ID NO: 362217 - DNA, 561 bp, Homo sapiens
  misc_feature: GZ8MTXP02IXDOK.45.39.D06.1.454.CMB.2.raw
  modified_base (165)..(165): a, c, t, g, unknown or other
  modified_base (250)..(250): a, c, t, g, unknown or other
  modified_base (254)..(254): a, c, t, g, unknown or other
  modified_base (302)..(302): a, c, t, g, unknown or other
  modified_base (344)..(344): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgtggttttccncgttagctcttttaagaggtgtccagtgtcaggtggaagtggtgcaggtccgggggagcgtggtccagcctgggagtccctgacnctcnctgtgagcgctgactcaccttcagtggctatggccttcactgggtccnccaggttcccaggcgaaggggctgggagtggttggcttgatntagtggtatgagtggacgagactaaactacgtttgactagactccgggtaggacgggggccgtagttcgaccacgtccgaccagacgacaattaccgaggaacactattgtatctaggacaagtagaacaactagacgacccgagacgacggtgtatacgttctgcgacgagagtaagtcggggttcgttacggtcggttcgggtactttcgtttag

SEQ ID NO: 362218 - DNA, 553 bp, Homo sapiens
  misc_feature: GZ8MTXP02IP6R8.45.39.D06.1.454.CMB.2.raw
  modified_base (252)..(252): a, c, t, g, unknown or other
  modified_base (282)..(282): a, c, t, g, unknown or other
  modified_base (374)..(374): a, c, t, g, unknown or other
  modified_base (483)..(483): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggacggtccctgaccnctctcctgtgaagcgcctggactcaccttnagtggctatggcccttcacgtgggtccgccacggttccaggcaaggggctgggagtggttggctgatatatggtatgatggagagactaaanacttgcagactcgtgagggcgattcacactcgcagagacaataccaggaacactatgtatcgtggacaatcgaacactagacgaccgaggacgacgggtgtatattacncgcgtacgagtaggaaggtcgggggttactacggtttcggttaccggggttaccgtttttacgtttacgg

SEQ ID NO: 362219 - DNA, 534 bp, Homo sapiens
  misc_feature: GZ8MTXP02GSEXE.45.39.D06.1.454.CMB.2.raw
  modified_base (375)..(375): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggtttttcctcgttgctcttttaagaggtgtccagtgtcaggtggaagtggtgcaggtccgggggagcgtggtccagcctgggagtccctgacactctcctgtgaagcgcctggactcaccttcagtggctatggcccttcacgtgggtccgccaggttcccaggcgaaggggctgggagtggttggctggatatatggtatgatggagagactaaacnctttgcagactcgtgagggcgatcacatcgccagagacaatccaaggacacattgtatctggacaatagaacaactgacgaccgagacgacggtatatattctgcgcgagacgaaggtcgggggttactacggttggtcgggtaccttttcgtttacgg

SEQ ID NO: 362220 - DNA, 514 bp, Homo sapiens
  misc_feature: GZ8MTXP02HOFS1.45.39.D06.1.454.CMB.2.raw
  modified_base (364)..(364): a, c, t, g, unknown or other
  modified_base (458)..(458): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgaagtggtgcagtccggggaggcgtggtccagcctgggaggtccctgacactctcctgtgaagcgcctggactcaccttcagtggctatggccttcacgtgggtccgccaggttcccaggcaaggggctggagtggtggctgatatatggtatgatggagagactaacnctttgcagactcggtgacggggcagttcaccatcgccagagacaatccagacacattgtatctgcaatgaacactgacgaccgagacgacggtntatattcgtgcgcgagagagtggggtctacgttcggtcggtctttcgtttagtcgg

SEQ ID NO: 362221 - DNA, 550 bp, Homo sapiens
  misc_feature: GZ8MTXP02J0ZI0.45.39.D06.1.454.CMB.2.raw
  modified_base (181)..(181): a, c, t, g, unknown or other
  modified_base (370)..(370): a, c, t, g, unknown or other
  modified_base (372)..(372): a, c, t, g, unknown or other
  modified_base (396)..(396): a, c, t, g, unknown or other
  modified_base (493)..(493): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagnggtgtccagtgtcaggtggaagtggtgcaggtccgggggagcgtggccagccgtgggagtccctgacactctcctgtgaagcgcctggactcaccttcagtggctatggccttcactgggtccgccaggttccaggcaaggggctggagtggtgctgatatatgtatgatgagagactaaacaattgananactcgtgacgggacgatacacacncgacacgaagaacaactaccgaacgaaacaactatatatactacgacgaagtaacgaaacaaacacgacgaccgacggaacgacggtagtatacttntcgcgcgagagaaggtcggggtacgttacgttcggttcggttaccgtttacgtttag

SEQ ID NO: 362222 - DNA, 581 bp, Homo sapiens
  misc_feature: GZ8MTXP02GC520.45.39.D06.1.454.CMB.2.raw
  modified_base (306)..(306): a, c, t, g, unknown or other
  modified_base (364)..(364): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggacgtccctgacactctcctgtgagcgcctggactcacctcagtggctatcggccttcacgtcgggtcccnccgtaggttcccagggcaaggggctggagtggttggctgatatagtggtatgatgganagactaactcttgacagacctcggaggacggggccgatcaccatcgaccagacgaacaacttaccgaagaaccaactattagttaatcgtaggacaaagtacgaaacaactacgaacgacccggaggacgacgggtacgtattattctgacgcgagaggtaggtcgggggttacgttacggttcgggttcgggttaccgtttccgtttacgttacgg

SEQ ID NO: 362223 - DNA, 550 bp, Homo sapiens
  misc_feature: GZ8MTXP02G334Y.45.39.D06.1.454.CMB.2.raw
  modified_base (355)..(355): a, c, t, g, unknown or other
  modified_base (372)..(372): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgaagcgcctggactcacttcagtggctatggccttcacgtgggtcccgcctaggttcccaggcaaggggctgggagtggttggctgatatatggtangatggagagactaaacnctttgacagactccgtgagggcgatcacatcgacagagacaataccagaacacgattgtatctggacaatagaacaactagacgacccgagacgacgggtagtattacttcgtcgcgacgagaggaaggtgggggttcctacggttcgggtttaccgggttaccgtttaccgtttagg

SEQ ID NO: 362224 - DNA, 574 bp, Homo sapiens
  misc_feature: GZ8MTXP02F294Q.45.39.D06.1.454.CMB.2.raw
  modified_base (311)..(311): a, c, t, g, unknown or other
  modified_base (388)..(388): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggaggtccctgaccactctcctgtgaagcgctggactcaccttcagtggctatggcccttcacgtgggtcccnccgtaggttcccaggcgaagggggcctgggagtgggttggcgtgatagtatggtatgagtggaacgtagactaaacnctttaggacagactccggtggacggggccgattcacatcgccagagacaatacagaacacattgtatctagacaagtacgaacaactagacgaccgaggacgacggtagtattacttacgtcgacgacgaggagaaggtcgggggttacttaccggttcggtttacgggtaccttttcgtttacgg

SEQ ID NO: 362225 - DNA, 654 bp, Homo sapiens
  misc_feature: GZ8MTXP02GNO8S.45.39.D06.1.454.CMB.2.raw
  modified_base (254)..(254): a, c, t, g, unknown or other
  modified_base (263)..(263): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtggaagtggtgcaggtccgggggagcgtggtccagccgtgggacgtccctgacnctctcctgngagcgcctgactcaccttcgagtgctagtcggcctttcgacgtcgggtcccgccgtaggttcccagggccgaaggggtctaggggagttgggttgctagatagtagtggtatggatgggaagtaacgtacttaaacgtacgtttagactaacggtaccgttccgggtagggaccgggggtaccctaaacttcccgaaccgtacgtacccgaccgaaggaacgaacctaaacgttaccgaaggtaaaccactagtttagtagtcgtaggaactaaacgtacgaaaccaaccgtaggaaccgacccggaaggacgtacggtagtacttacttcgacgcgacgagaggtaaggtcggggttactacggttcgggtccggttactttacgttagg

SEQ ID NO: 362226 - DNA, 556 bp, Homo sapiens
  misc_feature: GZ8MTXP02JG7HT.45.39.D06.1.454.CMB.2.raw
  modified_base (291)..(291): a, c, t, g, unknown or other
  modified_base (355)..(355): a, c, t, g, unknown or other
  modified_base (433)..(433): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccggggaggcgtggtccagcctgggagtccctgacactctcctgtgaagcgcctggactcaccttcagtggctatggccttnactgggtccgccaggttccaggccaaggggctggagtggttggctgatatatggtatgatgganagactacactttgacagactccggtgacgggccgattacaccatcgccagacgacaataccagaacacattgtatcgngcaatagaacactagacgaccgagacgtacggtacgtatattacgtgtcgacgaggtagaggtcgggggttacttaccggtttcggggttaccgggttaccgtttttcgtttacgtttacggg

SEQ ID NO: 362227 - DNA, 533 bp, Homo sapiens
  misc_feature: GZ8MTXP02FEKKI.45.39.D06.1.454.CMB.2.raw
  modified_base (163)..(163): a, c, t, g, unknown or other
  modified_base (276)..(276): a, c, t, g, unknown or other
  modified_base (291)..(291): a, c, t, g, unknown or other
  modified_base (301)..(301): a, c, t, g, unknown or other
  modified_base (366)..(366): a, c, t, g, unknown or other
  modified_base (432)..(432): a, c, t, g, unknown or other
  modified_base (434)..(434): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgtggtttcncgttagctctttaagaggtgtccagtgtcaggtgaagtggtgcaggtccgggggagcgtggtccagcctgggagtccctgacactctcctgtgaagcgcctggactcaccttnagtgctatggccttnactgggtccnccaggttccaggcaaggggctgggagtggttggctgatatatgggtatgatggagagactaaaanctttgcagactccgtgaggggcatcacatcgccagagacataccaggaacacattgtatctaggananagaacaacacgacgaccgacgacgacggtagtatacttctcgcgacgagagaaggtcggggttacgtacgttcggttcgggttaccgtttacgtttacg

SEQ ID NO: 362228 - DNA, 524 bp, Homo sapiens
  misc_feature: GZ8MTXP02F9RQ0.45.39.D06.1.454.CMB.2.raw
  modified_base (370)..(370): a, c, t, g, unknown or other
  modified_base (384)..(384): a, c, t, g, unknown or other
  modified_base (459)..(459): a, c, t, g, unknown or other
  modified_base (469)..(469): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggagtccctgacactctcctgtgaagcgcctggactcaccttcagtggctatggccttcacgtgggtccgccaggttccaggcaaggggctgggagtggttggctgatatagtggtatgatggagagactaaacnctttgcagactcgngacgggcgatcacatcgcagagacatccagaacacatgtatctggcaatgaacactgacgaccgagacacgggtntatacttcgngtcgacgagacgaagtcgggggtctacgttggttaccgggtactttccgtttagg

SEQ ID NO: 362229 - DNA, 545 bp, Homo sapiens
  misc_feature: GZ8MTXP02G32CG.45.39.D06.1.454.CMB.2.raw
  modified_base (305)..(305): a, c, t, g, unknown or other
  modified_base (368)..(368): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccggggaggcgtggtccagcctgggagtccctgacactctcctgtgaagcgcctggactcaccttcagtggctatggccttcacgtgggtcccnccgaggttccaggcgaaggggctggagtggttggctgatatatggtatgatggagagactacnctttgacagactcggtggacggggcgattcacagtcgaccagacgaacaactccgaagaacactattagtatcgtagacaatagaacaactgacgaccgagacgacggtacgtatattctgacgtcgagagagtgggggttactacggttcggttcgggtacctttcgttagttcgg

SEQ ID NO: 362230 - DNA, 670 bp, Homo sapiens
  misc_feature: GZ8MTXP02GI8JI.45.39.D06.1.454.CMB.2.raw
  modified_base (305)..(305): a, c, t, g, unknown or other
  modified_base (366)..(366): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgaagcgcctggactcaccttcagtggctatggccttcacgtgggtcccnccaggttcccaggcaaggggctggagtggttggctgatatatgtatgatggagagactaanctttgcagactccgtggacgggccgtattccgaccagtcgcccgaagacgacaaacttaccgaaggaaacaacctaagtttaggtacttcgttacgggtaccaaagttacggaaaacctaaaccgtacggaaacgaacccggaacgggaacgaaaccggggttaggttaacgttaaacgttttcgtacggtacgaccgggtaacggaacggtaaggttaacggggggtttaccgtttaacccgggtttcgggggtttacccgggggtttacccgtttttaccggttttaacggtttcccggggg

SEQ ID NO: 362231 - DNA, 592 bp, Homo sapiens
  misc_feature: GZ8MTXP02JNODK.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctctttaagagtgtccagtgtcaggtggaagtggtgcaggtccgggggagcgtggtccagcctgggagtccctgacactctcctgtgaagcgcctggactcaccttcagtggctagtcggccttcactcgggtccgccgaggttccaggcaaggggctggagtggttggctgatatagtggtatgagtggagagactaaacacgtttgactagacctccggtggacggggtaccgacttccaccgactccgccagacgacaacttaccgaaggaacactagttagtatctaggacaagtacgaaactaacctacgacgaacccgaggaccgacggggtagtattacgttcgtacggcgacgaggaggtaaggtcgggggttacgtacggttacgggttccgggttaccgttttcgtttacgg

SEQ ID NO: 362232 - DNA, 579 bp, Homo sapiens
  misc_feature: GZ8MTXP02GJ9GK.45.39.D06.1.454.CMB.2.raw
  modified_base (303)..(303): a, c, t, g, unknown or other
  modified_base (344)..(344): a, c, t, g, unknown or other
  modified_base (522)..(522): a, c, t, g, unknown or other
  modified_base (533)..(533): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgaagcgcctgactcactcagtggctagtcggccttcacgtgggtcccncgtacggtccaggcgaaggggctggagtggtggctgatatntgtatgagtggagaagaactaactcttgacaacgtaccgttcggagggacggggacctattccaacctacgccgaccgaagacgaactaacgtccgaaagaacactagttgtaacttcgaggactaaagtacgaaacaaccgtgaacgacccggtaagaccgagggtatattagttcngacgacgaagngaggtcgggttctacgttcgggtaccggtttactttcgtagtcggg

SEQ ID NO: 362233 - DNA, 555 bp, Homo sapiens
  misc_feature: GZ8MTXP02FY096.45.39.D06.1.454.CMB.2.raw
  modified_base (380)..(380): a, c, t, g, unknown or other
  modified_base (450)..(450): a, c, t, g, unknown or other
  modified_base (482)..(482): a, c, t, g, unknown or other
  modified_base (490)..(490): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgaagcgcctggactcaccttcagtggctatcggcctttcgacgtcgggtccgccaggttcccaggccaagggggctgggagtgggttgctgatatatggtatgatggaagagtactaaacnctttgactagactccggtagaggggccgatcaccatcgcagagacaataccagaacacatgtatctaganaatagaacactagacgaccgaggacacgggtntatacttntcgcgtacgagaggaagtcgggggttccttacggttcggttacggggttccgtttacgtttacgg

SEQ ID NO: 362234 - DNA, 530 bp, Homo sapiens
  misc_feature: GZ8MTXP02J024Y.45.39.D06.1.454.CMB.2.raw
  modified_base (397)..(397): a, c, t, g, unknown or other
  modified_base (400)..(400): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctatggccttcactgggtccgccaggttccaggcaaggggctggagtggtggctgatatatggtatgatggagagactaacactttgcagactcgtgagggcgatcacatcgccnganacaattccagaacacattgtatctggacaatgaaactaacctacgacgacccgaggacgacgggtcgtaatattcgtgcgcgagagagtgggggtctacgttcggttcgggtacctttcgtttacgtcgg

SEQ ID NO: 362235 - DNA, 525 bp, Homo sapiens
  misc_feature: GZ8MTXP02FWRHA.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgaagtggtgcagtccggggagcgtggtccagcctgggagtccctgacactctcctgtgaagcgcctggactcaccttcagtggctatggccttcactgggtccgccaggttccaggcaaggggctgggagtggttggctgatatatggtatgatggagagactaaacactttgacagactccgtgaggggccgattcaccatcgcagagacatcagaacacatagtatctggacaatgaacaactgacgaccgaggacgacggtagtatattactcgcgcgagagaagtgggggttactacgttggttcgggtacctttcgtttacg

SEQ ID NO: 362236 - DNA, 557 bp, Homo sapiens
  misc_feature: GZ8MTXP02J21NO.45.39.D06.1.454.CMB.2.raw
  modified_base (165)..(165): a, c, t, g, unknown or other
  modified_base (207)..(207): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttccncgttgctcttttaagaggtgtccagtgtcaggtggaagtggngcaggtccgggggagcgtggtccagcctgggaggtccctgacactctctgtgaagcgcctggactcaccttcagtggctatggccttcactgggtccgccaggttccaggcaaggggctggagtggttggctgatatatggtatgatggagagacgtaaacactttgacagacgtccgtggacggggccgattcaccagtcgccgagagacaacttaccaggaacacatgtatctgggacaatacgaacaactcgacgacccgaggacacgggtagtatacgttctacgcgacgagagaaggtcgggggttacgtaccgttgggttccgggttaccgtttccgtttacgg

SEQ ID NO: 362237 - DNA, 658 bp, Homo sapiens
  misc_feature: GZ8MTXP02IE73C.45.39.D06.1.454.CMB.2.raw
  modified_base (246)..(246): a, c, t, g, unknown or other
  modified_base (276)..(276): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggtttcctcgttgctcttttaagaggtgtccagtgtcaggtggaagtggtgcaggtccggggagcgtggtccagccgtgggagtccctgacnctctcctgtgaagcgcctggactcaccttnagtgctagtgccttcacgtgggtcccgccgtaggttccaggcaaggggctggtagtgggttggctagatatagtggtatgatggagagtaactaactcgtttgactacgtaccgtcggtaggacggggaccgtagtccaccgacgtccgaccagacgaactaacgtaccgaacggaactactaagtttacgtacttcgttacggactaaatacgaaacaccgtagaaccggacccggaggacgtacgggttagttaacgttacgtttcgtaggaccggtacggtaacgaggttaacgggttcgggggtttaaccgtttaccgggtttacgggggtttacccggggtttaacccgtttttaccggtttaacggtttaccgggg

SEQ ID NO: 362238 - DNA, 734 bp, Homo sapiens
  misc_feature: GZ8MTXP02JISCI.45.39.D06.1.454.CMB.2.raw
  modified_base (281)..(281): a, c, t, g, unknown or other
  modified_base (507)..(507): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccgagcgtgggaggtccctcgacactctctcgtgagcgcctgctcacctcagnggctatggtccttcacgtcggtccgccgacggttccgacggcgaaggggcgtgggtaggtggttggtctgatagtatggtatgagtggaagacgtacgtaaactacgtttacgacgacggtaaccgtccggtagggtaaacgggggcccgtaatttacccgaacccgtatacccggacccaggaacgaaacctaacgttaccaacgggtaaacacttacggtttanacgttactagggacctaagtacgaaaccaaccgtagacggaacccccggaagggtacccggtaaggggttacgttaacgttacgtttacccgttagggacccggtaacggtacggggtaaaagggttcgggggtttaaccggggggttttacccgtttaaacccgggggtttttggggtttacccccggggggttttaacccgtttttttcccgtttttaaaggggg

SEQ ID NO: 362239 - DNA, 682 bp, Homo sapiens
  misc_feature: GZ8MTXP02I64EU.45.39.D06.1.454.CMB.2.raw
  modified_base (279)..(279): a, c, t, g, unknown or other
  modified_base (287)..(287): a, c, t, g, unknown or other
  modified_base (307)..(307): a, c, t, g, unknown or other
  modified_base (318)..(318): a, c, t, g, unknown or other
  modified_base (333)..(333): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggagtccctgacactctctgtgagcgctggactcacttnagtgctancggtccttcgacgtcggccnccgaggttccnggcgaggggctgggngtggttggctgatatagtggtatgatggaagagactaaactacttgactagtacgtccggtgggaacggggcctaactccgaacctagtccgaccagaacgaactaacgtaccgaaaggaaacctaacgtaagtttacgtacttacggtacggaacctaaagttaccggaaacctaaccgtacggaacccggaacccggaacgggtaaccgtaaccggggtgtttaaacgttacgtttacgtacgggacgtaccggtaaggtaggttaacgggggtttcgggggtttaccgtttaccggggtttacggggtttacccggggtttaccccgtttttacggtttaacgggg

SEQ ID NO: 362240 - DNA, 567 bp, Homo sapiens
  misc_feature: GZ8MTXP02FZ0H1.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctatcggccttcacgtggggtccgccgaggttcccaggcgaaggggctgggagtgggttggctgatagtatggtatgatggagagactaaaactcttgcctagactccggtggacgggcgatcgaccatccgacagagaacaactaccaggaaacacattagtatctaggacaatacgaacaactagacgacccgaggacgacgggtacgtatacgtttcacgtcgacgagagaaggttcgggggttacgtacgttcgggttcgggtacctttcgtttacgg

SEQ ID NO: 362241 - DNA, 594 bp, Homo sapiens
  misc_feature: GZ8MTXP02H780A.45.39.D06.1.454.CMB.2.raw
  modified_base (275)..(275): a, c, t, g, unknown or other
  modified_base (344)..(344): a, c, t, g, unknown or other
  modified_base (365)..(365): a, c, t, g, unknown or other
tcagacgcgatcgacacgaccggtgctcgatttagtgacatctcgcagttctttggggctgggagaggagccccagcactagaagtcggcggtgtttccattcggtgatcagcactgaacacagaggactcaccatggagtttgggctgagctgggttttcctcgttgcttcttttaagaggtgtccagtgtcaggtggaagtgtgcaggtccggggagcgtggtccagcctgggacgtcctgacactctcctgtgaagcgcctgactcaccttnagtggctatggccttcacgtgggtcccgccgtacggttccgaggcgaaggggcgtggaggtgggttggntgaatatagtgtatgatgganagaactaactactttgacagtaccgtcggtgacgggccgtagtccacctatccgaccagacgaacgaacttacccgagaacaactattacgtatcgtaggacaatacgaaactaacgtacgaacgacccggaagacgtacgggtatagtttattcgtagcgacggagaggtaggttcggggttcttaccggtttgggttaccggtttccgttttacgtttacgtacggg

SEQ ID NO: 362242 - DNA, 571 bp, Homo sapiens
  misc_feature: GZ8MTXP02GV5E6.45.39.D06.1.454.CMB.2.raw
  modified_base (255)..(255): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgaccnctctcctgtgaagcgcctggactcaccttcagtggctagtcggccttcacgtgggtcccgccgtaggttcccaggcgaaggggctgggagtggtgctgatatagtggtatgatggagagactaaactctttgacagactccggtggacgggcatcacagtcgcagacgacactacgaagaacacattagtatctaggacaagtacgaaacacgtagacgacccgaggacgtacgggtatatacttcgacggtcgacgagagtaaggttcgggggttacttacggttgggttaccggttaccgttttacgtttacgg

SEQ ID NO: 362243 - DNA, 713 bp, Homo sapiens
  misc_feature: GZ8MTXP02IGW0C.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggagtccctgacactctcctgtgaagcgcctggacctcaccttcagtggctatcggccttcacgtcgggtcccgccgtaggttcccgaggcgaaaggggtctgggagttgggttggctgatatagtggtatgatgggagaagactaaactactttgactaacgacgtccgtagggaacggggtccgatttccgaccctagtcccgacgaacgaagaacctaaacgttaccgaaacgggaaaacaaccgtaagtttacgttaagtaccgttagggaccaaagttaacggaaacctaaacccgtacggaaccggaaccccggaacgggaaccgtaaccggggtacgtttaagttaacgtttcgtacggtccgtacggaacggtagggtaaacggggtttcgggggtttaaaccgttcccgggtttaccgggggttttacccggggtttaacccgttttttacccggttttaacgggg

SEQ ID NO: 362244 - DNA, 624 bp, Homo sapiens
  misc_feature: GZ8MTXP02I25DJ.45.39.D06.1.454.CMB.2.raw
  modified_base (253)..(253): a, c, t, g, unknown or other
  modified_base (309)..(309): a, c, t, g, unknown or other
  modified_base (333)..(333): a, c, t, g, unknown or other
  modified_base (345)..(345): a, c, t, g, unknown or other
  modified_base (372)..(372): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggagtggtgcaggtccgggggagcgtggtccagccgtgggagtccctgaccnctctcctgtgaagcgcctggactcaccttcagtggctatggccttcacgtgggccncaggttccaggcaaggggctgggngtggtgctgatntagtgtatgatggagtaagactaaacntttacggacaagactccggtaggacggggccgtattcaaccatcgaccgagagaactaacttaccgaaggaaaccaccgtaattcgttaatccgttaggacctaaagtacgaaaacctaccgtaacggacgaaccccgaggaacggtaacgggttacggtattacgtttacgtcggacgacggaagtaggtaaggttcgggggttacttaccgggttagggtttccgggttaccgtttttaccgttttacgg

SEQ ID NO: 362245 - DNA, 520 bp, Homo sapiens
  misc_feature: GZ8MTXP02FQ3G7.45.39.D06.1.454.CMB.2.raw
  modified_base (353)..(353): a, c, t, g, unknown or other
  modified_base (360)..(360): a, c, t, g, unknown or other
  modified_base (370)..(370): a, c, t, g, unknown or other
  modified_base (475)..(475): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgaccactctcctgtgaagcgcctggactcaccttcagtggctatggccttcactgggtccgccaggttcccaggcaaggggctgggagtggttgctgatatatggtangatgganagactaaacnctttgacagactcgtgaggggcatcacatcgccagagacaatacagaacacattgtatctggacaatagaacactacgacgaccgagacacgggtatatacttcngcgcgagagaagtggggttctacgttggtcggtactttcgtttag

SEQ ID NO: 362246 - DNA, 532 bp, Homo sapiens
  misc_feature: GZ8MTXP02FM0UC.45.39.D06.1.454.CMB.2.raw
  modified_base (304)..(304): a, c, t, g, unknown or other
  modified_base (365)..(365): a, c, t, g, unknown or other
  modified_base (393)..(393): a, c, t, g, unknown or other
  modified_base (466)..(466): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggaggtccctgacactctcctgtgagcgcctggactcaccttcagtggctatggccttcactgggtcccncaggttccaggcaaggggctggagtggttggctgatatatggtatgatggagagaactacncttgcagctcgtgacgggccattccacntcgccagacgacaatccgagaacacattagtatcgtaggcaatcgaaacactagacgaccgagacgacgggtntagtattcgtgacgcgagaggtaggtggggttctacgttgggtcggttaccttttccgttagtcgg

SEQ ID NO: 362247 - DNA, 535 bp, Homo sapiens
  misc_feature: GZ8MTXP02JV827.45.39.D06.1.454.CMB.2.raw
  modified_base (309)..(309): a, c, t, g, unknown or other
  modified_base (373)..(373): a, c, t, g, unknown or other
  modified_base (402)..(402): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtggggagtccctgacactctcctgtgaagcgcctggactcaccttcagtggctagtcggccttcacgtgggtcccnccgtaggttccaggcgaaggggctggagtggtgctgatatagtggtatgagtggagagactaancttgcagactcgtgacgggcattcgacancgaccagagacaatccagaacacgattgtatcgtggacaatcgaaacaacctagacgaccgaggacgacggtgtatattcgtgcgcgagagtagtggggtctacgttcggttacggtccgtttcgttagtcgg

SEQ ID NO: 362248 - DNA, 671 bp, Homo sapiens
  misc_feature: GZ8MTXP02HOGQB.45.39.D06.1.454.CMB.2.raw
  modified_base (178)..(178): a, c, t, g, unknown or other
  modified_base (256)..(256): a, c, t, g, unknown or other
  modified_base (277)..(277): a, c, t, g, unknown or other
  modified_base (343)..(343): a, c, t, g, unknown or other
  modified_base (359)..(359): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagnggtgtccagtgtcaggtggaagtggtgcaggtccgggggagcgtggtccagccgtgggagtccctgacactctcctgngaagcgcctggactcaccttnagtggctatggccttcacgtgggtcccgcgaggttccaggcgaaggggctggagtggttgctgatntagtggtatgatgganagaactacactttgctagctccggtggacggggcctattccacctatccgaccagacgaactaacgttaccgaaggaacactaagtttgtaacttcgtacgggactaaagtacgaaaaccgtaaccgtacggaacggaaccccggaaagggtacccgtaaccgggggttaagttaaacgtttacgtttaccgtcggacggtaccggtacggtaaggtaacggggttcggggggtttaccgtttaccggggttttacgggggtttacccggggtttaccccgttttttaccggttttaacggtttcccggggg

SEQ ID NO: 362249 - DNA, 563 bp, Homo sapiens
  misc_feature: GZ8MTXP02FSXQA.45.39.D06.1.454.CMB.2.raw
  modified_base (449)..(449): a, c, t, g, unknown or other
  modified_base (457)..(457): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggagtccctgaccactctcctgtgaagcgcctggactcaccttcagtggctagtcggcctttcacgtcggggtcccgccgtaggttcccaggcgaaggggctgggagtgggttggctgatatagtggtatgatggagagactaaacacgtttgcagacctcggtgacggggccgtatcaccatcgaccagagacactaccagaacacattnatctgganactagaacactagacgaccgaggacgacggtgtatacttcgtcgcgcgagaggtaaggtcgggggttacttacgttcgggttaccggttaccgttttccgtttagg

SEQ ID NO: 362250 - DNA, 553 bp, Homo sapiens
  misc_feature: GZ8MTXP02HNAZA.45.39.D06.1.454.CMB.2.raw
  modified_base (305)..(305): a, c, t, g, unknown or other
  modified_base (357)..(357): a, c, t, g, unknown or other
  modified_base (366)..(366): a, c, t, g, unknown or other
  modified_base (383)..(383): a, c, t, g, unknown or other
  modified_base (435)..(435): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcgtggttttcgtcgttaggctcttttaagaggtgtccagtgtcaggtggaagtggtgcagtccgggggaggcgtggtccagcctgggaggtccctgacactctcctgtgaagcgcctggactcaccttcagtggctatggccttcactgggtccnccaggttccaggcaaggggctggagtggtggctgatatatggtatgatgganagactaacnctttgcagacttccggnggacgggcgtatcaccatcgcagacgacaactacacgaacactattagtatntgacatagaacaacacgacgaccgacgacgacggtacgtagtattcgtgtcgacgacgaggtaggtggggttcggttaccggttacgggttcgggttaccgtttacgtttacgttcgg

SEQ ID NO: 362251 - DNA, 516 bp, Homo sapiens
  misc_feature: GZ8MTXP02FT9PY.45.39.D06.1.454.CMB.2.raw
  modified_base (365)..(365): a, c, t, g, unknown or other
  modified_base (461)..(461): a, c, t, g, unknown or other
tcagacgcgatcgacacgaccggtgctcgatttagtgacatctcgcagttctttgggggctggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggagtccctgacactctcctgtgaagcgcctggactcaccttcagtggctatggccttcactgggtccaccgaggttccaggcaaggggctggagtggttgctgatatatggtatgatggagagactaacncttgcagactcgtgagggcatcacatcgcagagacaactcagaacacattgtatcgtggacatgaacactgacgaccgaggcgaggtctatattcngcgacgacgagagtgggggttctacgttcggttcgggtactttccgttagtacgg

SEQ ID NO: 362252 - DNA, 551 bp, Homo sapiens
  misc_feature: GZ8MTXP02F12AY.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctatggccttcactgggtccgccaggttccaggcaaggggctgggagtggttggctgatatagtggtatgatggagagactaaacactttgcagtactccgtgaggggccgattcacatcgccagagacaataccaggaacacattgtatcgtggacaatacgaacaactagacgaaccgacggacgtacggtagtatacttcagtcgacgagagtaaggtcgggggttacgtaccggttgggttccgggttactttcgtttacgg

SEQ ID NO: 362253 - DNA, 605 bp, Homo sapiens
  misc_feature: GZ8MTXP02HI262.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggacggtccctgacactctcctgtgaagcgcctggactcaccttcagtggctatggccttcactgggtccgccgaggttccaggcaaggggctgggagtgggttggctgatagtatggtatgattggagagactaaactactttgacagaccgtccgtggacggggccgtacgttcaaccactcgaccagacgaacaacttaccaaggaacactattagtatcgtaggacaagtagtaacaacgtagacgaccgaaggaccgtaaccgggtagtagtacttgtacgacgccggtaaggaggtaacggttacgggggttacgttaccggttcggggtttaccggggttaccgttttaccgtttacggg

SEQ ID NO: 362254 - DNA, 736 bp, Homo sapiens
  misc_feature: GZ8MTXP02HXHFZ.45.39.D06.1.454.CMB.2.raw
  modified_base (387)..(387): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggccagcctgggagtccctgacactctcctgtgagcgcctggactcaccttcagtggctatcggtccttcacgtggggtcccgcagggttcccagggcaagggggctgggaggttgggttggctggatatagtggtatgagtggaacgagtacgtaaaacncgttttgaccaaggtaccgttcccgggttagggacgggggtacccgtacgtttacccgaacccgaaacgtcccgacccgaacgaacggaaaccctaaacgtttacccgaaagggaaaccctaaacctaaagtttacgttaaacgttcgtacgggtaacctaaaagtacggtaaaaccaaacccgtacggaaaccggaaccccggaaacggggaaccgtaaccggggttacggtaaacttacgtttaccgttaggaccggtaccggacggtaacgggtaaggttacggggggttacctttacccgggttcggggtttacccggggtttacccgtttttacggtttaacgg

SEQ ID NO: 362255 - DNA, 580 bp, Homo sapiens
  misc_feature: GZ8MTXP02HCER6.45.39.D06.1.454.CMB.2.raw
  modified_base (349)..(349): a, c, t, g, unknown or other
  modified_base (406)..(406): a, c, t, g, unknown or other
  modified_base (487)..(487): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagccgtgggagtccctgacactctcctgtgaagcgctggactcaccttcagtgctagtcggccttcacgtgggtcccgcgtaggttccaggcgaaggggctgggagtggtgctgatntagtggtatgagtggagagactaaactcttgacagacgtcgtggagggccagtcacngtccgcagacacactaccgagaacactatgtatctggacaagtacaaacaaccgtagaccgaaccgaggaccgtacgggtntacgttagttccgagtccgacgaaggtagtaagggttcgggggttaccgttacgggttcgggtttaccggggtttacctttttacgtttacgg

SEQ ID NO: 362256 - DNA, 826 bp, Homo sapiens
  misc_feature: GZ8MTXP02JDFT0.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcggtggtccagccgtgggacgtccctgacactctcctgtgaagcgcctggactcaccttcagtcggctatcggccttcacgtgggtccgccgtacggttccaggcgaaggggcctgggagtgggttggctggtaattagtagtgggtatggagttgggaagaacgtacgttaaactacgtttacggaccgtaaggtaaccgttcccgggtaggggtaacccgggggtacccgtaaacgtttaccccgaaacccgtaacgttacccggacccgtaaacgggtaaaccgaaaccgttaaaccgttacccgaaaacgggaaaaccctaaaccgttaagtttacgttaaacgttccgtacgggtaacctaaaacgttaacgaaaaccccgtaaacccggttacggaaacccgggtaaccccgggtaaacggggaacccggttaaccgggggttaacggtttaagttaaaccggttttacggttacggaccgggtaaccggtaaggggtaaacgggttaagggggtttaccggggggtttacctttaacccgggggtttcgggggtttacccgggggtttaaccccgttttttccggttttaaccggg

SEQ ID NO: 362257 - DNA, 559 bp, Homo sapiens
  misc_feature: GZ8MTXP02JP4RR.45.39.D06.1.454.CMB.2.raw
  modified_base (254)..(254): a, c, t, g, unknown or other
  modified_base (281)..(281): a, c, t, g, unknown or other
  modified_base (364)..(364): a, c, t, g, unknown or other
  modified_base (494)..(494): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggaggcgtggtccagccgtgggacgtccctgacnctctctgtgagcgctggactcaccttnagtggctatcggccttcacgtgggccgccacggttccaggcgaaggggctgggagtggtggctgatatagtggtatgatgganagactaaactcttgacagtacctcgtaggacggggcctatcgacatccgacagagacaataccgaagaacactattagtatcgtgacaatacgaacactagacgaccgagacgacggtatagtacttcgngcgacgaggagtaagggttcggggttacttacggttggttaccgggttaccttttacgtttacgg

SEQ ID NO: 362258 - DNA, 521 bp, Homo sapiens
  misc_feature: GZ8MTXP02IJF9H.45.39.D06.1.454.CMB.2.raw
  modified_base (353)..(353): a, c, t, g, unknown or other
  modified_base (369)..(369): a, c, t, g, unknown or other
  modified_base (382)..(382): a, c, t, g, unknown or other
  modified_base (394)..(395): a, c, t, g, unknown or other
  modified_base (402)..(402): a, c, t, g, unknown or other
  modified_base (416)..(416): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccaggccgtgggacgtccctgacactctcctgtgaagcgcctggactcaccttcagtggctatggccttcactgggtccgccaggttccaggcaaggggctgggagtggtgctgatatatggtangatggagagactaacnttgacagactcgngagggcatcacnncgcaganacatcagacacatntatctgacagtacgaactacgagacgaccgagacgacggtgtatattctgcgacgagagaaggttcgggggttactcggttcggtacggttacctttcgtttagg

SEQ ID NO: 362259 - DNA, 548 bp, Homo sapiens
  misc_feature: GZ8MTXP02JRONP.45.39.D06.1.454.CMB.2.raw
  modified_base (252)..(252): a, c, t, g, unknown or other
  modified_base (310)..(310): a, c, t, g, unknown or other
  modified_base (348)..(348): a, c, t, g, unknown or other
  modified_base (373)..(373): a, c, t, g, unknown or other
  modified_base (398)..(398): a, c, t, g, unknown or other
  modified_base (421)..(421): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggacgtccctgacnctctcctgtgaagcgcctggactcaccttcagtggctatcggccttcacgtgggtccnccgaggttccaggcaggggctgggagtggtcgctgatntatggtatgatggagagactaaacnttgcagctcggtgacgggcatcacntcgacagacactactcagaaacntattgtatctaggacaagtacgaacaacgtagaacgaccgagacgacggtagttactactttcgacgtcgacgagagtaaggtcggggttctacggtttcggttacgggttacctttcgtttaaggg

SEQ ID NO: 362260 - DNA, 643 bp, Homo sapiens
  misc_feature: GZ8MTXP02FZC9U.45.39.D06.1.454.CMB.2.raw
  modified_base (273)..(273): a, c, t, g, unknown or other
  modified_base (277)..(277): a, c, t, g, unknown or other
  modified_base (317)..(317): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagcgtggtttcgcgtaggctctttaagaggtgtccagtgtcaggtggaagtggtgcagtccggggagcgtggtccagcctgggagtccctgacactctcctgtgaagcgcctggactcaccttngtgntatgctctacgtcggtcgcgacgtcgagacgaggcgtggngtggtggtcgtgatagtagtagtagtagtagtaggagagtaacgtaacgtaacgttacgtacgtacgtacgtacgtacggtacgggtaccgtacgtacgtacctacgtacgtaccgacgaacgaacgtaacgtaccgaacgaacgtaactagtagtagtacgtacgtacgtaagtaacgaaacgtaaccgtacgaacgaaccggaacggaacgtaacggtacggtacgttacgttacgtacgtacgtacgtacgtaaggtacggtaacggggttacggttaccggttacgggttaccgggttaccggtttaccgtttacgttacgg

SEQ ID NO: 362261 - DNA, 541 bp, Homo sapiens
  misc_feature: GZ8MTXP02I55Y6.45.39.D06.1.454.CMB.2.raw
  modified_base (250)..(250): a, c, t, g, unknown or other
  modified_base (345)..(345): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctggggagtccctgacnctctctgtgagcgcctggactcaccttcagtggctatcggccttcactgggtccgccaggttccaggcaaggggctgggagtggttgctgatatntggtatgatggagagactaaacactttgactagactccgtgagggcgattcgacatcgacagagacaatcagacactatgtatcgtggacatagaactaacgtagacgacccgaggacgacggtgtaactattcgtagcgacgagagaagtcgggggttactacggttcgggttccggttacgttttcgtttacgg

SEQ ID NO: 362262 - DNA, 578 bp, Homo sapiens
  misc_feature: GZ8MTXP02GXUGT.45.39.D06.1.454.CMB.2.raw
  modified_base (250)..(250): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacnctctctgtgagcgctgactcactcagtgctatcggccttcacgtcgggtccgccgtaggttcccaggcgaaggggctgggaggtggtggctgatatagtggtatgatggagagactaaactctttgactagactccggtggacggggcctagttcaccagtccgacagagacaactacgaagaacactatgtatcgtagacaagacgaacaactacggacgaaccggaggacgtacgggtatagttacttcgtacggtcgacgaggtaggtaacggttcgggggttaccttacggttcgggtttccgggttaccttttacgtttacgg

SEQ ID NO: 362263 - DNA, 625 bp, Homo sapiens
  misc_feature: GZ8MTXP02IC3NU.45.39.D06.1.454.CMB.2.raw
  modified_base (344)..(344): a, c, t, g, unknown or other
  modified_base (366)..(366): a, c, t, g, unknown or other
tcagacgcgatcgacacgaccggtgctcgatttagtgacatctcgcagttctttggggctggggagaggagccccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtcggggagcgtggtccagcctgggagtccctgacactctcctgtgagcgctggactcaccttcagtggctatcggtcccttcacgtgggtccccaccgtaggttccaggcgaaggggctgggagtggttggntgatatagtggtatgatggganagactaactctttgctagaccgtccggtgacggggccgtatccaccagtccgccagacgaactaactaccgagaacactattgtaattcgtaggacaagtacgaaaacctaacctacggaacggacccggagggaaccgtacgggtacgttaagttacgtttcgtacggaccgtacgaggtaaggtaggggttcgggggtttaacttccggggtttacgggtttcccgggggtttaccttttaccggtttagtccgggg

SEQ ID NO: 362264 - DNA, 532 bp, Homo sapiens
  misc_feature: GZ8MTXP02GA0KE.45.39.D06.1.454.CMB.2.raw
  modified_base (303)..(303): a, c, t, g, unknown or other
  modified_base (355)..(355): a, c, t, g, unknown or other
  modified_base (364)..(364): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctatggccttcactgggtccnccaggttccaggcaaggggctggagtggtggctgatatatggtatgatgganagactaacncttgcagactcgtgacgggcgattcacatcgcagagacaatccagacacattgtatctgcaatgaacaactgacgacccgagacgacggtagtatatttctagcgtcggagaggtaggtgggggttactacggttcggttcggggtaccttttacgttacgtttcggg

SEQ ID NO: 362265 - DNA, 579 bp, Homo sapiens
  misc_feature: GZ8MTXP02GDN4Y.45.39.D06.1.454.CMB.2.raw
  modified_base (308)..(308): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcacctcagtggctatcggtccttcacgtcgggtccnccgtacggttccagacgaaggggctgggaggtggtgctgatatagtggtatgatggagagtactaaactacttgacagtactcgtggagggcgtatcacatcgacagagaactaactacgaacgaaacactattagtatcgtaggacaatacgaaacaaccgtagaacgaacccggaagaacgtacgggtagtattacttcgtacgcgacgagagtaaggttcgggggttacttacggttcgggttccgggttaccgttttacgtttacgg

SEQ ID NO: 362266 - DNA, 664 bp, Homo sapiens
  misc_feature: GZ8MTXP02IKBVW.45.39.D06.1.454.CMB.2.raw
  modified_base (249)..(249): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggttgtccagtgtcaggtggaagtggtgcaggtccgggggagcgtggtccagctgggagtccctgacnctctctgtgaagcgcctggactcaccttcagtggctatggccttcacgtgggtccgcaggttccaggcaaggggctgggagttggtggctgatatagtggtatggatggaacgagtacgtaaactactttagactacgtacgtccggtggacgggggtccgattcacctagtaccgaccgagacgaacaacgttaccgacggaaacaacgtaatttagtacgtaccttgggacaaacgtagaaacaaccgtacggaacgaacccggaagggaaccgaacggggttacgtaagttacgtttaccgtaggtccggtacggaacggtaaggtaacgggttcgggggggtttacctttaccggggtttacgggggtttaccgggggtttaacccgttttttacccgtttttaacggggg

SEQ ID NO: 362267 - DNA, 549 bp, Homo sapiens
  misc_feature: GZ8MTXP02FNY6M.45.39.D06.1.454.CMB.2.raw
  modified_base (185)..(185): a, c, t, g, unknown or other
  modified_base (280)..(280): a, c, t, g, unknown or other
  modified_base (361)..(361): a, c, t, g, unknown or other
  modified_base (371)..(371): a, c, t, g, unknown or other
  modified_base (387)..(387): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtntccagtgtcaggtgagtggtgcaggtccgggggagcgtggtccagccgtggggacgtccctgacactctcctgtgaagcgcctggactcaccttnagtggctatggccttcacgtgggtccgccaggtttccaggcaaggggctgggagtggttgctgatatatggtatgatgganagactaaacnctttgcagactccggngacggggcgagttcaccatcgaccagagacaataccagaaacacattgatctaggacaatcgaacaaccgtagacgaccgaggtacgaacgggtcgtatactttctagcgacgagaggaagtcggggttactacggttggttacgggtacgtttcgtttacg

SEQ ID NO: 362268 - DNA, 519 bp, Homo sapiens
  misc_feature: GZ8MTXP02JEYGG.45.39.D06.1.454.CMB.2.raw
  modified_base (301)..(301): a, c, t, g, unknown or other
  modified_base (362)..(362): a, c, t, g, unknown or other
  modified_base (478)..(478): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggagtccctgacactctcctgtgaagcgcctggactcaccttcagtggctatggccttcactgggtccnccaggttccaggcaaggggctggagtggtggctgatatatggtatgatggagagactaacnctttgcagactcgtgagggccgattcacatcgccagacgacaatccagaacacattgtatctggcaatgaacaacctgacgaccgagacgacgggtagtactattctgcgtcgagngagtgggggtctacgttcggtcggtactttcgttagttcgg

SEQ ID NO: 362269 - DNA, 800 bp, Homo sapiens
  misc_feature: GZ8MTXP02GOYCN.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccagccgtgggacggtccctgacactctcctgtgaagcgcctggactcaccttcagtggctatcggccttcacgtcgggtcccgccgtaggttcccgaggccgaaggggtctgggaggttgggttggcgtagattagttagtgggtatggagtcgggaagaacgtaaactaacgtctttaggacctaaggtaccgtccgggtagggaccgggggtacccgtaagtttacccgaacccgtaacgtcccgacccgaacggaaccgtaacctaaacgttacccgaaacgggtaaacctaaccgtaaatttacgttaacgttaccgtacgggtaacctaaagtaacgaaaacccgtaaacccgttacggaaacccggtaaccccggaaaggggaaccggtaaaccgggggtttagttaaacgtttaacgttttaccggtacggacccggtaacggaacgggtaacgggttaggggtttaaccggggggttttacccgtttaaacccggggttttccgggggtttaacccgggggttttaacccttttttcccgggttttaaacggtttacccggggg

SEQ ID NO: 362270 - DNA, 547 bp, Homo sapiens
  misc_feature: GZ8MTXP02FL9IG.45.39.D06.1.454.CMB.2.raw
  modified_base (308)..(308): a, c, t, g, unknown or other
  modified_base (373)..(373): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtgggtccagccgtgggaggtccctgacactctcctgtgaagcgcctggactcaccttcagtggctatggccttcacgtgggtccnccaggttcccagggccaaggggctggagtggttggctgatatatggtatgatggagagactaacnttgcagcctcggtggacggggcgatccacatcgccgagacgacaactccaaggaacacattagtatcgtaggacaagtagaacaacgtgaacgaccgaggacgacgggtagtatattctgcgcgagagtagtggggttctacgttcgggtccggttactttccgttagttacgg

SEQ ID NO: 362271 - DNA, 780 bp, Homo sapiens
  misc_feature: GZ8MTXP02JCE6X.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggaggtccctgacactctcctgtgagcgcctggactcaccttcagtggctagtcggtccttcgacgtcggggtcccgccgtacgggtttcccaaggggtaccaaacggggggtcttacggggaggtttggggtttcgggccttggaaattagtaagttggggttaaatggtaaggttaggggaacgaacgtaaccgttaaaacgtaccgtttttaggaccgtaacggtaaccgttcccgggttaggggaaccgggggacccggtaacgtttacccgaacccgtacgtacccgacccgaaggtaacgaaaccgtaaacttaccgaaacggaaaccacgtaattacgtatacgtacggtacaacgttacgaacctaaaccgtacgaaccggaacccggacgggaaccggtaaccggggttagttagtttaacgtttcgttcgggtacccgtacggaaggtacggtaaggggttacggggggtttaccgttacccgggtttcggggtttaccgggggtttaccccgtttttacggtttttaacggg

SEQ ID NO: 362272 - DNA, 550 bp, Homo sapiens
  misc_feature: GZ8MTXP02HGWOG.45.39.D06.1.454.CMB.2.raw
  modified_base (370)..(370): a, c, t, g, unknown or other
  modified_base (391)..(391): a, c, t, g, unknown or other
  modified_base (415)..(415): a, c, t, g, unknown or other
  modified_base (485)..(485): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggaggtccctgacactctcctgtgaagcgcctggactcaccttcagtggctatcggcccttcacgtcggggtcccgccgtaggttcccagggcgaaggggctgggagtggttggctgatagtatggtatgatgganagactactcttgcagctcggngagggccatccacagtcgccaganacaatccagaacatacttgtatctaggacaatagaacactagacgaccgagacgacggtgtatattacgngtcgacgacgagtaggtcgggggttcttacggttcgggttcgggttaccttttcgtttacgtcgg

SEQ ID NO: 362273 - DNA, 541 bp, Homo sapiens
  misc_feature: GZ8MTXP02JB5RY.45.39.D06.1.454.CMB.2.raw
  modified_base (162)..(162): a, c, t, g, unknown or other
  modified_base (303)..(303): a, c, t, g, unknown or other
  modified_base (341)..(341): a, c, t, g, unknown or other
  modified_base (353)..(353): a, c, t, g, unknown or other
  modified_base (361)..(361): a, c, t, g, unknown or other
  modified_base (479)..(479): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttccncgttgctcttttaagaggtgtccagtgtcaggtggaagtggtgcagtccgggggagcgtggtccagcctgggaggtccctgacactctcctgtgaagcgcctggactcaccttcagtggctatggccttcacgtgggtccncaggttccaggcaaggggctggagtggtgctgatatanggtatgatgganagactacncttgcagactcgtagacgggcgagttcacatcgcagagacaatccaggaacacgattagtactcgtaggacaaatacgaacaaccgtagacgaccggagacgacggtgtagtattcgngtacgcgagacgaggtcgggggtactacggttcggttcgggttacctttccgttagtacggg

SEQ ID NO: 362274 - DNA, 637 bp, Homo sapiens
  misc_feature: GZ8MTXP02JC1QT.45.39.D06.1.454.CMB.2.raw
  modified_base (374)..(374): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggaggcgtggtccagccgtgggacggtccctgacactctcctgtgaagcgcctggactcaccttcagtggctatggccttcacgtgggtcccgccgtaggttcccgaggcgaaggggctgggaggtggttgctgatatagtggtatgatgganagactaaatcgttgacagacgtccggtagggacggggtccgacttaccgacctagtcccgaccaacggaacgaacctaacgttacccgaaggaaacctactagttacgtatcgtaggacaaagtacgaaacaaccgtagaaccgaaccggaggaacgtacggggtacgtaagtacgttcgtacgtcgacggtagaggtaagggttcgggggttacgttacggtttcgggtttaccggggtttaccgttttaccggttttacgg

SEQ ID NO: 362275 - DNA, 601 bp, Homo sapiens
  misc_feature: GZ8MTXP02FWUUC.45.39.D06.1.454.CMB.2.raw
  modified_base (309)..(309): a, c, t, g, unknown or other
  modified_base (377)..(377): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggagcgtggtccagccgtgggacgtccctgacactctctgtgagcgcctggactcaccttcagtggctatcggccttcacgtcggggtcccnccgtacggttccaggcgaaggggctggaggtggtggctgatatagtggtatgagtggagagaactaancttgactagacctccggtagggacggggaccgtattaccacactcgaccgagacgaactaacttaccgaaacggaacactattagtactcgtaggacaaatacgaaaccaacgtagaacgaccggaaggacgacgggtacgtattacttcgtagcgcgaggacgtgggtcggggttactacggtttacgggttaccgggtttactttaccgtttagttaccggg

SEQ ID NO: 362276 - DNA, 630 bp, Homo sapiens
  misc_feature: GZ8MTXP02HW31C.45.39.D06.1.454.CMB.2.raw
  modified_base (280)..(280): a, c, t, g, unknown or other
  modified_base (294)..(294): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggacgtccctgacactctcctgtgaagcgactggactcacttnagtgctatgccttnacgtggtccgcaggtccaggcaaggggctggagtggtgctagatagtagtgtatgatggagagactaaatctttgactagtactccggtaggacggggtaccagttacacagtcgaccagagaacaactaccgaaggaaactctaagttagtatacgtaggacctaaagtacgaaactaacgtacgacgaacccgaaggaaccggtacgggtacgttaagttacgttacgttacggacgacggtaacggtaagggtaacgggttacggggggtttaccttaccgggtttacgggggtttaccccgggggtttaccttttttacccggtttaacggg

SEQ ID NO: 362277 - DNA, 577 bp, Homo sapiens
  misc_feature: GZ8MTXP02JGD9P.45.39.D06.1.454.CMB.2.raw
  modified_base (250)..(250): a, c, t, g, unknown or other
  modified_base (308)..(308): a, c, t, g, unknown or other
  modified_base (348)..(348): a, c, t, g, unknown or other
  modified_base (361)..(361): a, c, t, g, unknown or other
  modified_base (363)..(363): a, c, t, g, unknown or other
  modified_base (369)..(369): a, c, t, g, unknown or other
  modified_base (494)..(494): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtccgggggaggcgtggtccagccgtgggagtccctgacnctctcctgtgagcgcctggactcaccttcagtggctatcggccttcacgtgggtcccnccgtaggttccaggcgaagggctggagtggtgctgatatntggtatgatggananaactancttgacagactcgtgacgggcatcacatcgaccagacgactaactaccgagaactactattagtactcgaggtacaatacgaaacacgtcgaacgaccgtagacgacgggtagtacttattacgngtacgacgacgaggtacggttcgggggttaccttaccggtttacggggttacgggtttacccttttacgtttacgttccgggg

SEQ ID NO: 362278 - DNA, 645 bp, Homo sapiens
  misc_feature: GZ8MTXP02IAAVW.45.39.D06.1.454.CMB.2.raw
  modified_base (276)..(276): a, c, t, g, unknown or other
  modified_base (359)..(359): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccggggagcgtggtccagccgtgggagtccctgacactctcctgtgagcgctgactcacctnagtgctagtgccttcagtcgggtccgcaggttccaggcgaaggggctgggagtgattggctgatagtagtggtatgatggaanagaacttaaacactttgacagtactccggtaggacgggccgtagttcaccagtaccgaccgagacgaactaacttaccgaaacggaaactacgtagtttacgtagtacgtacggactaaagtacgaaaccaaaccgtaggaaacggaacccggaaacgggaacgtaacggggttagttaaacgtttacgtttacgtacggtacggtacggaaggtaaggtacgggttacgggggtttaccgttaccgggtttcggggtttaccgggggtttacccgtttttaccgg

SEQ ID NO: 362279 - DNA, 533 bp, Homo sapiens
  misc_feature: GZ8MTXP02FNBPW.45.39.D06.1.454.CMB.2.raw
  modified_base (250)..(250): a, c, t, g, unknown or other
tcagacgcgatcgacacgaccggtgctcgatttagtgacatctcgcagttctttggggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacnctctcctgtgaagcgcctggactcaccttcagtggctatggccttcactgggtccgccaggttccaggcaaggggctgggagtggtggctgatatagtggtatgatggagagactaaacactttgcagactccgtgaggggcgattcaccatcgacagagacattaccgagaacacattgtatctaggtacatagaacaactgacgaccgagacgacggtagtatacttctcgcgacgagagaagtggggttctacgttggttcgggtacctttcgtttacgg

SEQ ID NO: 362280 - DNA, 657 bp, Homo sapiens
  misc_feature: GZ8MTXP02JJL3V.45.39.D06.1.454.CMB.2.raw
  modified_base (249)..(249): a, c, t, g, unknown or other
  modified_base (274)..(274): a, c, t, g, unknown or other
  modified_base (309)..(309): a, c, t, g, unknown or other
tcagacgcgatcgacacgaccggtgctcgatttagtgacatctcgcagttctttggggctgggagagaagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccagccgtgggagtccctgacnctctcctgtgaagcgcctggactcnccttcagtggctatcggccttcaccgtgggtcccnctaggttccaggcgaaggggctggagtggtggctgatatatggtatgatggagagaactaactcttagcagaccgtccggtggacggggccgattccaccagtccgccgagacgaactaactaccgaacggaacaactattagtaactcgtacggactaaagtacgaaaccgaaccgtaggaacggaaccccggaagggaacccgtaacggggttacgttaacgttacgtttacgtacggtacgacggaacggaggtacgggttaacggggggtttaccgtttacccgggttttacgggggtttacccggggtttaacccgtttttaccggtttacggtttaccgggg

SEQ ID NO: 362281 - DNA, 877 bp, Homo sapiens
  misc_feature: GZ8MTXP02GK4DW.45.39.D06.1.454.CMB.2.raw
  modified_base (254)..(254): a, c, t, g, unknown or other
  modified_base (262)..(262): a, c, t, g, unknown or other
  modified_base (279)..(279): a, c, t, g, unknown or other
  modified_base (311)..(311): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacnctctctgngagcgctgactcacttnagtgctagtcggcctttcacgtcggggtcccnccgacggtttccccgagggccggaaagggggtccttaggggaggtttggggtttcgggcgttaggaatttagttagttaggggtattaggacggttagggaagtaacgtaaccgttaaaactacgtttttacgaccgtaaacgtacccggtttcccggggttaggggaaccggggggtacccttaaccgtttacccgaaaccccgtaacggttacccggaccccgaaagggaaacggtaaacccttaaaaccgttaccccggaaaacgggaaaacccctaaacgttaacgtttaggttaacgttaccggttacggggaaacctaaaacgttaacgggaaaacccctaacccggtaacgggaaacccggaaccccggggaaaacggggtaaaccggtaaccgggggtttaaggttaaccttttaacggtttaccgttcggggtaaccgggaaccggtaagggtaaaccggggtgggggtttaaccggggggtttacccgtttaaaccggggttttcggggggtttaacccggggttttaacccgtttttacccggtttttaacgggg

SEQ ID NO: 362282 - DNA, 579 bp, Homo sapiens
  misc_feature: GZ8MTXP02F9XR0.45.39.D06.1.454.CMB.2.raw
  modified_base (251)..(251): a, c, t, g, unknown or other
  modified_base (383)..(383): a, c, t, g, unknown or other
  modified_base (393)..(393): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggagtccctgacnctctcctgtgagcgcctggactcaccttcagtggctagtcggtccttcacgtcggggtcccgccgtaggttcccgagggccgaagggggcctggggaggttgggttggctgatatagtggtatggatggganagactaaacnctttgactagactccggtaggacggggcagttcacactcgacagagaactaactaccgaaggaaacactaattgtatcgtaggacaagtacgaacaacgtagacgaccgaggacacgggtatatagttcacgcgacgagagtaaggtcggggttcttacggttcggttcggtactttcgtttacgg

SEQ ID NO: 362283 - DNA, 684 bp, Homo sapiens
  misc_feature: GZ8MTXP02JJUHG.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgagcgcctggactcaccttcagtggctagtcggccttcacgtcgggtccgccgtaggttccaggcgaagggggcctggggagtgggttcggctgattatagtggtatgagtggaagagtactaaactctttagcaagtaccgtccggtggacgggggtccctagttacccgaccgagtcccgacgaacggaacgaaccgtaacttacccgaaggtaaaccacgtaagtttaggtaactacgttacgggaacctaacgtacggaaaacctaccgtacggaaccggaacccggaacgggacgtaaccgggggttattacgttaacgtttccggacggtaccggacggaaggtagggtaacgggttacgggggttaccgtttaccgggtttacggggtttacccgggtttacccttttacggttacgg

SEQ ID NO: 362284 - DNA, 634 bp, Homo sapiens
  misc_feature: GZ8MTXP02IPT08.45.39.D06.1.454.CMB.2.raw
  modified_base (252)..(252): a, c, t, g, unknown or other
  modified_base (311)..(311): a, c, t, g, unknown or other
  modified_base (484)..(484): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcagggtggaagtggtgcgaggtccggggagcgtggtccaggcctggggacgtccctgacnctctcctgtgagcgcctggactcaccttcagtgctagtcggccttcgacgtcgggtccnccgtaggttcccgaggaccgaaggggtctgggtaggtggttggctgatagtagtggtatgagtggagaacgaactaacgtctttgactagtaccgtcggtagggacgggctatccacactcgaccaagacgaactaactaccgaaagaacaacttattgtaactcgtacgganaactagaaaccaaccgtagaacgacccgaaggacgtacgggtagtattagttcgtggtacgacgtaggtacggtaagggttcgggggttaccgttaccggtttacggggtttaccgggtttaccgtttttaccggttacggtttacgggg

SEQ ID NO: 362285 - DNA, 700 bp, Homo sapiens
  misc_feature: GZ8MTXP02JY0KQ.45.39.D06.1.454.CMB.2.raw
  modified_base (162)..(162): a, c, t, g, unknown or other
  modified_base (309)..(309): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttccncgttgctcttttaagaggtgtccagtgtcaggtggaagtggtgcaggtccgggggaggcgtggtccagccgtgggacggtccctgacactctcctgtgaagcgcctggactcaccttcagtggctatcggccttcgacgtgggtccnccgtaggttcccaggcgaggggctggagtggttggctgatagtagtggtatgagtaggagagactaactcgttgcagtacgtcggtagggacggggccgtagttaccaccgtacgtccgacccgagaacgaactaaacgttaccgaaggaaacctaacgtaagtttaggttaactaccgttagggacctaaagtaacgaaacccgtaaaccgtaacggaaaccggaaccccgggaaacgggaaccggtaaccggggttaggttaacgtttacgtttcgtacggccggtacggaacggtaaggtacggggttaacgggggtttaccgtttaccgggtttacggggtttacccgggggtttacccgtttttaccgtttaacggttaccggggg

SEQ ID NO: 362286 - DNA, 625 bp, Homo sapiens
  misc_feature: GZ8MTXP02FQ4A4.45.39.D06.1.454.CMB.2.raw
  modified_base (286)..(286): a, c, t, g, unknown or other
  modified_base (309)..(309): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctctttaagaggtgtccagtgtcaggtggaagtggtgcaggtccgggggagcgtggtccagccgtgggacggtccctgacactctcctgtgagcgcctggactcaccttcagtggctancggtccttcacgtcgggtacccnccgtaggttcccaggtccgaaggggcctagggagtggtggctgatatagtggtatgatggacaagactaacgtcttgactacgctccggtaggacgggcgattacgacaatcgaccagacgactaacgtaccgaaacgaacctaatattagtactagtacggaactaataacggaaacaaccgtaggaacgaccggaacggtaacggtaccggtagtacttaaggtttcacggcgacgtaaggcggtaaggttcgggggttacttaaccggttcggggtttaccggggttaaccgttttccgtttacggtaccggg

SEQ ID NO: 362287 - DNA, 579 bp, Homo sapiens
  misc_feature: GZ8MTXP02HHR6F.45.39.D06.1.454.CMB.2.raw
  modified_base (253)..(253): a, c, t, g, unknown or other
  modified_base (283)..(283): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggaagtggtgcaggtccgggggagcgtggtccagcctgggacgtccctgacnctctcctgtgaagcgcctggactcaccttnagtggctatcggtccttcgacgtcgggtcccgccgacggttcccaggccgaagggggcctgggagtgggttggctgatatagtggtatgatggaagagactaaactcttgacagactccggtggacggggcgacgttcaccatcgacagagactaactcaagaacactatagtatctaggacaagtacgaacaaccgtagacgaccgagacgacggtagtactattcgtagccgacgagagtaaggtgggggttacgttacggtttacgggttcggtttaccgtttacgtttacgg

SEQ ID NO: 362288 - DNA, 586 bp, Homo sapiens
  misc_feature: GZ8MTXP02F3C38.45.39.D06.1.454.CMB.2.raw
  modified_base (282)..(282): a, c, t, g, unknown or other
  modified_base (310)..(310): a, c, t, g, unknown or other
  modified_base (360)..(360): a, c, t, g, unknown or other
  modified_base (379)..(379): a, c, t, g, unknown or other
  modified_base (395)..(395): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagccgtgggacgtccctgacactctcctgtgagcgcctggactcaccttnagtgctatcggccttcacgtcgggtccnccgtacggttccaggcgaaggggctgggacgtggttggctgatatgtgtngagtggagagactaaactntttgacagactccggnggacggggccgtagtccaactacgtccgacagagaactaagtaccaggaacactattagtatcgtaggacaagtacgaactaacgtacgacgaacccggacgtaacgtacgggtagttattacgttctcggcgacggagaggtaaggtcgggggttactacggttcggttccgggttactttcgtttacgg

SEQ ID NO: 362289 - DNA, 594 bp, Homo sapiens
  misc_feature: GZ8MTXP02HO3NN.45.39.D06.1.454.CMB.2.raw
  modified_base (300)..(300): a, c, t, g, unknown or other
  modified_base (312)..(312): a, c, t, g, unknown or other
  modified_base (408)..(408): a, c, t, g, unknown or other
  modified_base (468)..(468): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcgaggtccgggggaggcgtggtccaggcctgggaggtccctgacactctcctgtgaagcgcctggactcaccttcagtggctagtcggtccttnacgtgggtcccnccgtaggttccgaggtcgaagggggctgggagttggttggctagtatagtagtggtatggactgggagacgaactaacgtcttgacagtccgtcgnggacgggcgtatcacagtcgacagagacacgtaccagaaccatagttgtatctagacaangaaacacctagaccgaccgaggacgtacgggtagtacttagttcgtagaccgacgaaggtacggtagggttcggggttacttaccgggtttcggggttaccggtttacccgtttcgtttagtcggg

SEQ ID NO: 362290 - DNA, 545 bp, Homo sapiens
  misc_feature: GZ8MTXP02H8QRR.45.39.D06.1.454.CMB.2.raw
  modified_base (364)..(364): a, c, t, g, unknown or other
  modified_base (482)..(482): a, c, t, g, unknown or other
  modified_base (487)..(487): a, c, t, g, unknown or other
  modified_base (502)..(502): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggaggtccctgacactctcctgtgagcgcctggactcaccttcagtggctatggccttcacgttgggtccgccgtaggttccaggccgaaggggctgggagtggttggctgatatatggtatgagtgganagaactaatactttgactagaccgtcgtagggacgggccgattccacagtcgcagagacaactcagacacattgtatctggacaagtacgaacacgtacgacgaccgagacgacggtntattnttcgcgcgcgagagnggtggggttctacgttcggttcggtaccttttcgttacgtcgg

SEQ ID NO: 362291 - DNA, 624 bp, Homo sapiens
  misc_feature: GZ8MTXP02IACQI.45.39.D06.1.454.CMB.2.raw
  modified_base (372)..(372): a, c, t, g, unknown or other
  modified_base (421)..(421): a, c, t, g, unknown or other
tcagacgcgatcgacacgaccggtgctcgatttagtgacatctcgcagttcttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcgagggtccgggggaggcgtggtccagccgtgggacgtccctgacactctcctgtgagcgcctggactcacttcagtgctatcggccttcacgtcgggtcccgccgtaggtccgaggcgaaggggctgggagtgagttggctggatatagtgtatgatggaganaactaaactctttgactagtactcggtacggacgggcgtattccaaccngtaccgaccagaacgactacttaccgaaggaacaactattagtagtcgtaggactaagtacgaaacgaaccgtacggaaccgaaccgaacggacgtacgggttagtaactttacgttacgacgtcgaacggagtaagggtacggttcgggggttaccgttaccgggtttcgggtttacccggggttttacccgtttttaccgg

SEQ ID NO: 362292 - DNA, 690 bp, Homo sapiens
  misc_feature: GZ8MTXP02G5EUU.45.39.D06.1.454.CMB.2.raw
  modified_base (312)..(312): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctctgtgagcgcctggactcaccttcagtcggctagtcggccttcacgtcggggtcccnccgtacggttccagggccgaagggggctggggagttggttgggctgaatagtagttgggtactggagtagggaagaacgtaaactaaccgtacttttcggacgtaacgacccgttcgggtacgggacgggggtacccgtacttacccgaaccgtacgtaccgacccgaaacggacgaactaaacgttaccgaaggaaaccacgtactttagtacgtaccgtagacgtaaacgtacgaaaccgtaaccgtaggaaccggaacccgtaacggaaccgtaacgggttagttaacttagtttacgtaggcggacggagaggtacggttaacgggggttcttaacggttcggttacgggttaccttttcgttacgttacgggg

SEQ ID NO: 362293 - DNA, 597 bp, Homo sapiens
  misc_feature: GZ8MTXP02HRUFC.45.39.D06.1.454.CMB.2.raw
  modified_base (386)..(386): a, c, t, g, unknown or other
  modified_base (393)..(393): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggaggcgtggtccagccgtgggagtccctgacactctcctgtgagcgcctggactcaccttcagtggctagtcgccttcacgtgggtacccgccgtaggttcccagggtcgaagggggtctaggggtaggtggttggctggaattactagtgggtatgagtggaganactaaanactttgactagactcgtgagggtcatcacatcgacagacaacaacttaccgaagaacactatcgttatctaggacagtacgaaacacgtagacgaccggagacgtacggtagttatctttcgacgcgaacgaggtaagtaaggttacgggggttacctttacggttacggggtttaccggggttacctttttaccggtttacgg

SEQ ID NO: 362294 - DNA, 611 bp, Homo sapiens
  misc_feature: GZ8MTXP02ISDJ3.45.39.D06.1.454.CMB.2.raw
  modified_base (251)..(251): a, c, t, g, unknown or other
  modified_base (361)..(361): a, c, t, g, unknown or other
  modified_base (368)..(368): a, c, t, g, unknown or other
  modified_base (384)..(384): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagcctgggacgtccctgacnctctcctgtgagcgctggactcacttcagtggctatggccttcacgtggtccgcctaggttcccaggcaaggggctgggagtggtggctgatatatggtatgatggaganactaaanctttgcagactcgtgngggcatcacatcgcagagacaactccagaacacgtattagtatctaggacctaagtacgaaacctaaccgtagacgaacccggaggaaccggtacgggtacgttaagttacgttttacgtacggttccggacggtacggtaaggtaacggggttacggggggtttaccgtttaaccgggtttcgggggtttacccggggtttaccgtttttacccggtttttacggg

SEQ ID NO: 362295 - DNA, 725 bp, Homo sapiens
  misc_feature: GZ8MTXP02JZXXZ.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtggaagtggtgcgaggtccgggggagcgtggtccagccgtgggacgtccctgacactctcctgtgagcgcctgactcaccttcgagtgctagtcggtccttcgacgttcgggtcccgccgtacggttcccgaggaccgtaagggggtctaggggtaggttgggttcggcgttagaagtttagtaaggttgggttaaactgggtaagttacggggaaagtaacgttaacccgtaaaacgttacgtttagacccgtaaggtaacccgttccgggtaggggaccggggtaccctacgttcccgaaaccgtgtacccgaccgaaagtaacgtaaacctaacgttacccgaaagtaaacctacttagttacgtatccgtaggtacctaaagtaccgaaaccgtaccgacggaaccgacccggtaagaaccggtacgggtatactacggtttcgcggacgacggtaaggtacggtggggttcgggtttaccgttacgggtttcgggttaccggtttaccctttaggtacgg

SEQ ID NO: 362296 - DNA, 617 bp, Homo sapiens
  misc_feature: GZ8MTXP02GS2TJ.45.39.D06.1.454.CMB.2.raw
  modified_base (310)..(310): a, c, t, g, unknown or other
  modified_base (360)..(360): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccaggccgtgggaggtccctgacactctcctgtgagcgcctggactcaccttcagtggctatcggccttcacgtggggtcccnccgtacggttccaggccaaggggctgggagttggtgctgatatatggtangatggagagaactaactctttgcagactgagtggaggggctatccacgatccgcagagactaagtaccaagaacactaattgtaatcgtaggacaaagtacgaaaccaacgtagaaccgaacccggagaacccgtagggtacgttaagttacgtttcgtacgtacggaccggaaggtaaggaacgggtttcgggggttaccgtttaccggttttacggggtttacccggggtttacccgtttttacggttttaacgg

SEQ ID NO: 362297 - DNA, 528 bp, Homo sapiens
  misc_feature: GZ8MTXP02F9SRY.45.39.D06.1.454.CMB.2.raw
  modified_base (296)..(296): a, c, t, g, unknown or other
  modified_base (304)..(304): a, c, t, g, unknown or other
  modified_base (369)..(369): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccggggaaggcgtggtccagccgtgggaggtccctgacactctcctgtgaagcgctggactcaccttcagtgctatggccttnactggccnccaggttccaggcgaaggggctgggagtggttggctgatatatggtatgatggagagactaaacnctttgcagactcgtgagggcgatcacatcgcagagacatacgagaacacattgtatctggacaatagaacaacgtagacgaccgagacgacggtgtatacttcgtacgcgacgagagaagtgggggttactacggttggttcggtacctttcgtttacg

SEQ ID NO: 362298 - DNA, 668 bp, Homo sapiens
  misc_feature: GZ8MTXP02GJYYK.45.39.D06.1.454.CMB.2.raw
  modified_base (275)..(275): a, c, t, g, unknown or other
  modified_base (305)..(305): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctctgtgacgcgcctggactcaccttnagtggctagtcggccttcacgtgggtcccnccgtaggttcccgaggtccgaaggggtcctagggagttgggttggcttgatagtgtgtatgagtcggaagacgtaactaacgtctttgacagtaccgttccgggaggacggggccgtattaccgactacgtaccgccgaagacgaactaacgttaccgaacggtaaacaccgtaagtttaggtacttacgtacggacctaaagtacgaaacgaaccgtaggaaacggacccggaacgggaacggtaaccggggttaattaacgtttagttccgtaggaccggtcgaaggtacggtagggttcgggggttacttaccggttacggggtttaccggttacccgtttttaccgttacgttccgggg

SEQ ID NO: 362299 - DNA, 631 bp, Homo sapiens
  misc_feature: GZ8MTXP02F4BB4.45.39.D06.1.454.CMB.2.raw
  modified_base (252)..(252): a, c, t, g, unknown or other
  modified_base (278)..(278): a, c, t, g, unknown or other
  modified_base (484)..(484): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggttgtccagtgtcgaggtggaagtggtgcgaggtccgggggagcgtggtccagccgtgggacgtcctgacnctctctgtgacgcgctggactcactnagtgctgtcgtccttcgacgtcgggtcccgcgtacggttcccgaggcgaaggggtctgggtagtgggttgctagattagtagtggtatgactgggagaataactaatcttagacgaacgtccgtcggtagggacggggacctatacccgactactcgaccgagacgtaactaacgtccgaaagactactagttagtactgacgtanaataacgaacacgtagaacgacccgaaggtacgtacggtataagtttactcgtacggacgtacggaacgtggtaacggggttcgggggttacccttacgggtttaccggggttccgggtttaaccctttggtttacgtttaacgggg

SEQ ID NO: 362300 - DNA, 574 bp, Homo sapiens
  misc_feature: GZ8MTXP02GF2AP.45.39.D06.1.454.CMB.2.raw
  modified_base (205)..(205): a, c, t, g, unknown or other
  modified_base (301)..(301): a, c, t, g, unknown or other
  modified_base (347)..(347): a, c, t, g, unknown or other
  modified_base (365)..(365): a, c, t, g, unknown or other
  modified_base (531)..(531): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtncgaggtccgggggagcgtggtccagccgtgggagtccctgacactctctgtgagcgctggactcaccttcagtgctatcggccttcactgggtccnccaggttccaggcgaaggggctggagtggtggctgatagtatgtangagtagagaagactaacncttagcgtaagccttacggagggacgggaccgtacttcccaacacgtaccgaccgaaggaacaacgtaacttaaccgaaacgtaaccaaatattagtaacttcgaggaactaagacaactaacgagaacgacgtagaacgaggttatattattcagcgtcgaacgngtaggtgggttctcggttcgggtcggttacctttgtacgtcgg

SEQ ID NO: 362301 - DNA, 641 bp, Homo sapiens
  misc_feature: GZ8MTXP02HULNP.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagcctgggacgtccctgaccactctcctgtgacgcgcctggactcaccttcagtggctagtcggtcccttcacgttcgggtccccaacccgtggtttcccagggccgaaagggggcgtggaggttgggttggcgtgaatagtatggtatgagtggagtacaacttaactactttgacctagtacctccgggtaggacgggggtaccctacgttacccacctacgtccgacccgagaacgtaactaaacgttacccgagaaacactagtttagtactgtacggactaatagaaacaagttacgaggaacggaacccgacggacgtacgggtagtattacgttcacggtcgacgaggacgtaaggttcgggggttactaccggtttgggttccgggttacgtttttcgtttacgg

SEQ ID NO: 362302 - DNA, 577 bp, Homo sapiens
  misc_feature: GZ8MTXP02GPB6O.45.39.D06.1.454.CMB.2.raw
  modified_base (163)..(163): a, c, t, g, unknown or other
  modified_base (308)..(308): a, c, t, g, unknown or other
  modified_base (356)..(356): a, c, t, g, unknown or other
  modified_base (387)..(387): a, c, t, g, unknown or other
  modified_base (522)..(522): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttccncgttgctcttttaagaggtgtccagtgtcaggtggaagtggtgcaggtccggggagcgtggtccagccgtgggacgtccctgacactctcctgtgaacgcgcctggactcaccttcagtggctagtggccttcacgtgggtcccncgtaggtccaggcaaggggtctgggagtggttgctgatagtatggtangagtggagagactatcttgacagacgtcggngacgggcctatcacagtccgacagacgaactaacttaccgagaactaacgtagttcgtattcgtagacaagtacgaaacaaccgtagaacgtacccgaggaccgtacggtacgtattagttctaggcgacgacgngtacggtggggttacctacggttcggttaccggttacttttaccgttagtacggg

SEQ ID NO: 362303 - DNA, 625 bp, Homo sapiens
  misc_feature: GZ8MTXP02JYAMV.45.39.D06.1.454.CMB.2.raw
  modified_base (280)..(280): a, c, t, g, unknown or other
  modified_base (309)..(309): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccaggccgtgggacggtccctgacactctcctgtgagcgcctggactcacctnagtggctatggccttcacgtggggtcccnccgacggttccaggcgaaggggctgggagtggtggctgatatatggtatgatggagagaactacactttgacagccgtcggtggacggggccgactcaccatccgccagacgaactaacttaccgagaacactacttagtacttacgtaggtactaacgtacgaaaccaaccgtaggaacgaacccggacggacgtacgggttagtaagttacgtttcgtacgcggtacgaaggtaggtaggttcgggggtttaccgttaccgggtttacggggtttaccggggtttaccgtttttcccgtttaggtttaccgggg

SEQ ID NO: 362304 - DNA, 533 bp, Homo sapiens
  misc_feature: GZ8MTXP02F2LAZ.45.39.D06.1.454.CMB.2.raw
  modified_base (373)..(373): a, c, t, g, unknown or other
  modified_base (386)..(386): a, c, t, g, unknown or other
  modified_base (398)..(398): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagccgtgggacgtccctgacactctcctgtgaagcgctggactcaccttcagtggctatggccttcacgtgggtccgccaggttccaggcgaaggggctgggagtgggttgctgatatatggtatgatggagagactaaacncttgcagactcgngagggcatcacntcgcagacgacaatacagaacactattcgtatctaggacaagtacgaacaactagacgaccgagacgacggtagtatacttcgtgcgacgagagtaaggtcggggtctacgttggttacggtactttcgtttacg

SEQ ID NO: 362305 - DNA, 775 bp, Homo sapiens
  misc_feature: GZ8MTXP02HB7HB.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagcctgggagtccctgacactctctgtgaagcgctggactcaccttcagtggctagtcggtccttcacgtcggggtcccgccgtaggttcccgagggtccgaaacggggggtcctaggggtaggttggggttcggccttaggaattagtagttggggttatggaagttggggaagaacggtactaaaaccgtgtttagacctagtaaccgtccgggtagggaacgggggtacccgtaacgtttcccgaacccgtagttacccgaccgaaacggaacggaaacctaaacgttacccgaaacgggaaacctaaccgtaagtttacggttaattaccgttacgggaacctaaagttaccgaaaacccgtaaaccgtacggaacccggaaccccggaacgggtaaaccggtaaccggggtaggttaaacttaacgttttaccgtggtaccggtaccggaaggtaagggtaacgggtttcggggggttacctttaccggggtttacggggtttaccggggtttacccgtttttaccggttttaaccggg

SEQ ID NO: 362306 - DNA, 560 bp, Homo sapiens
  misc_feature: GZ8MTXP02HE91Y.45.39.D06.1.454.CMB.2.raw
  modified_base (364)..(364): a, c, t, g, unknown or other
  modified_base (374)..(374): a, c, t, g, unknown or other
  modified_base (382)..(382): a, c, t, g, unknown or other
  modified_base (396)..(396): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgctggactcaccttcagtggctagtggccttcacgtgggtcccgccgaggttccaggcgaaggggctgggagtggttggctgatatagtgtatgatgganagactaaacnttgcagcncggtgagggcatcncatcgcagagacatacagaacactatgtatcgtaggacaatagaactaactagacgaacccgaggacgtacgggtatagttactttacgcgtacgcggtagaggtaaggtcgggggttaccttacgggttcgggttaccgggtttaccgttttacgtttacggg

SEQ ID NO: 362307 - DNA, 669 bp, Homo sapiens
  misc_feature: GZ8MTXP02HMPXQ.45.39.D06.1.454.CMB.2.raw
  modified_base (270)..(270): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggagcgtggtccagccgtgggacgtccctgacactctcctgtgaagcgccnggactcaccttcagtggctagtcgcttcacgtcgggtccgccgaggttccagggcaaggggctgggaggtggttggctagatagtatggtatgagtggagaagactaaactgtttagactagtaccgtcggtaggaacggggcccgtagttaccaccgactccgaccgaaggaacgaactaaacgttaccgaaaggaaaccaactagttacgttaactcgttacgggaccaaagtacggaaaaccaaccgtaacggaaccggaaacccggaagggaaccgtacggggtagttaacgtaacgtttcgtacggacgaccggaaggacggtaagggttacgggggtttacgttacccgggtttacggggtttcccgggttacccggtttttacgtttacggg

SEQ ID NO: 362308 - DNA, 643 bp, Homo sapiens
  misc_feature: GZ8MTXP02JI043.45.39.D06.1.454.CMB.2.raw
  modified_base (309)..(309): a, c, t, g, unknown or other
  modified_base (349)..(349): a, c, t, g, unknown or other
  modified_base (363)..(363): a, c, t, g, unknown or other
  modified_base (371)..(371): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggaggcgtggtccaggccgtgggacggtccctgacactctctgtgagcgctggactcaccttcagtggctatggccttcacgtgggtcccncaggttccgagccgaagggctggagtggttgctgatagtntggtatgatagganagactaanctttgacagactccgtagacgggccgagttcacacgtacgaccgagacgaacaacgttaccgaggaaaccactaagttgtaacgttccgtaggaccgtaaattaccggaaacaacccttaggaacgaaccccggaaggaaccgaacgggtaggttaaacttagtttacgtacgtaccggccgaacggtaggtacgggttaacgggggttccgttaaccggtttcgggggtttaccggggtttaaccctttttccggtttaagtttcccgggg

SEQ ID NO: 362309 - DNA, 742 bp, Homo sapiens
  misc_feature: GZ8MTXP02GCNFJ.45.39.D06.1.454.CMB.2.raw
  modified_base (182)..(182): a, c, t, g, unknown or other
  modified_base (252)..(252): a, c, t, g, unknown or other
  modified_base (280)..(280): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagnggtgtccagtgtcaggtggaagtggtgcaggtccgggggaggcgtggtccagccgtgggagtccctgacnctctcctgtgagcgctggactcaccttnagtggctatcggtccttcacgtcggtccgccgtaggttccgaggacgaaggggctgggtaggtgggttggcgtgtatagtagtggtatgagtggaagtaagtacgtaaactacgtttgaccgtaagtacgtcccgggtagggacgggggtaccgtaacgttaccaaccgtacgttacccgaccgaacggaacggtaacctaaacgttacccgaaaacgggtaaacctaaacctaaagttttacggttacgttaccgtacgggtaactaaacgtacgaaaacccgtaaaccgtacggaaccggaaacccggaacgggtaaaccggtacggggttaacgttaagtttacgttttacggtacggtaccggtaacggaggtaacgggtaaggttacgggggtactttaccgggtttacccggtttacgggggtttacccggggtttaaacccgtttttttaccggg

SEQ ID NO: 362310 - DNA, 548 bp, Homo sapiens
  misc_feature: GZ8MTXP02JW6O3.45.39.D06.1.454.CMB.2.raw
  modified_base (166)..(166): a, c, t, g, unknown or other
  modified_base (361)..(361): a, c, t, g, unknown or other
  modified_base (386)..(386): a, c, t, g, unknown or other
  modified_base (453)..(453): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttccncgttgcttcttttaagaggtgtccagtgtcaggtggaagtggtgcaggtccgggggaggcgtggtccagcctgggagtccctgacactctcctgtgaagcgcctggactcaccttcagtggctatggccttcactggtccgccaggttccaggcgaaggggctggagtggtgctgatatagtggtatgagtgganagactaaacactttgcagactccgnggacggggcgattcaccatacgaccagacgacaacttccaaggaacactattagtatacgtacgganaacgtacgaacaacgagacgaccgagacgacgggtagtatattcgtagcgcgagagaagtggggtctacggttggttccggtactttcgtttacg

SEQ ID NO: 362311 - DNA, 726 bp, Homo sapiens
  misc_feature: GZ8MTXP02JL6XK.45.39.D06.1.454.CMB.2.raw
  modified_base (341)..(341): a, c, t, g, unknown or other
  modified_base (364)..(364): a, c, t, g, unknown or other
  modified_base (373)..(373): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtggaagtggtgcaggtccgggggaggcggtggtccagccgtgggacggtccctgacactctcctgtgagcgctggactcacttcagtgctagtcggccttcacgtcggtccgccgaggttcccaggcgaaggggctagggngtgattggctggatagtatgtanggatggaangtaactaaactacgtttagctacggtactaccggtaggacggggaccgtacgttaccaccgtacgtacgaccgagaacgaacctaacgttaccgaaacggaactaactaacgttacgtactaccggttaggaactaaagttacgaaaaccgaaaccgttacggaaacccgtaaaccgggaacggtaccgggtaaaccgggggttaagtttaacggtttaactttaccggtacgggtaccggttacggaaaccggggttaagggtaaacggggtttcggggggtttacccggtttaaacccggggttttccgggggtttacccgggggttttacccggtttttttaacccgggg

SEQ ID NO: 362312 - DNA, 647 bp, Homo sapiens
  misc_feature: GZ8MTXP02GA9V0.45.39.D06.1.454.CMB.2.raw
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccaggccgtgggaggtccctgacactctcctgtgagcgcctggactcaccttcagtggctatcggccttcacgtgggtcccgcctaggttcccaggcgaaggggctgggagtgggttggctgatatagtggtatgatggagagaactaacgactttgacagtactcggtaggacggggaccgattcaccacgtccgaccgagacgaactaacgttaccgaacggaacaacgtacttagtatacgtaggacctaaagtacgaaaccgaaccgtaggaaaccggaacccggaacgggaacgtaccggggtagttaagttactttcgtggacgtacggtaggaggtagggttcgggggttaccgttaccggtttcgggggtttaccggggtttaccgtttttaccggtttacgttaccgggg

SEQ ID NO: 362313 - DNA, 561 bp, Homo sapiens
  misc_feature: GZ8MTXP02HOOSU.45.39.D06.1.454.CMB.2.raw
  modified_base (253)..(253): a, c, t, g, unknown or other
  modified_base (362)..(362): a, c, t, g, unknown or other
  modified_base (430)..(430): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggaagtggtgcaggtccgggggagcgtggtccagccgtgggagtccctgacnctctctgtgaagcgcctggactcaccttcagtggctatggccttcactcgggtccgccaggttccaggcaaggggctgggagtggttgctgatatagtgtatgatgganagactaaactctttgcagactccgtgacgggcattcacatcgcagagacatacagaacagattgtatntggacaatagaacaactgaacgacccgagacgtacgggtgtagttactttcgcgtacgacgaggagtaacggttgggggttaccttaccggtttcggggttaccggggttacccttttttacggtttacgg

SEQ ID NO: 362314 - DNA, 570 bp, Homo sapiens
  misc_feature: GZ8MTXP02JVGK0.45.39.D06.1.454.CMB.2.raw
  modified_base (409)..(409): a, c, t, g, unknown or other
  modified_base (533)..(533): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagccgtgggagtccctgacactctcctgtgaagcgcctggactcaccttcagtggctatggccttcacgtgggtccccgccgtaaggttcccgacggtcgaaacgggggcctggggagttggagtttggctggtatatagtggtatggatggagagactaaactctttgcagactccgngtaggggccgtattcaccatcgacagagacaacttccaaaggacaactagttagtatccgtaggacaagtacgaacaacctagacgacccgaggtacacgggtgtatattcgtacgcgtcgagngagtggggtactacgtcggtttacggggtacttttcg

SEQ ID NO: 362315 - DNA, 727 bp, Homo sapiens
  misc_feature: GZ8MTXP02GQLQW.45.39.D06.1.454.CMB.2.raw
  modified_base (259)..(259): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtggaagtggtgcgaggtccgggggagcgtggtccagccgtgggacgtcctgacactctctgngagcgcctggactcaccttcagtggctagtcggtccttcacgtgggtcccgccgtaggttcccaggccgaaggggctggagttggtgctgatagtatggtatgagtggtagagaactaacgtctttaggacgagtaccgtccgggtagggacggggaccgtaagttccgaaccacgtaccgccgaagacgtaacaaacgttacccgaagaaacctaaacgtaagtttacgttaaacgttcgtacggtacgtaaaacgttaacgaaaaccgtaaacccgttacgggaaaccggaacccgggaacgggtaaaccggtacggggttaacgttaacgtttacgttttacgtacggtacggaccggtaaacgggtaaggttacgggttaacggggggtttacgttaccgggtttaccgggggttttacccggggtttacccggtttttaccggtttacggtttaacccggggg

SEQ ID NO: 362316 - DNA, 707 bp, Homo sapiens
  misc_feature: GZ8MTXP02FIC79.45.39.D06.1.454.CMB.2.raw
  modified_base (297)..(297): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtggctagtggccttnacgtgggtccgccgaggttccaggcgaaggggctggagtggttggctgatatagtggtatgtatggagaacgtactaaaactacgtttgctaagaccgtccggtaggacgggggccgtacttccaccgactccgaccaaggacgaaacgtaaacgttacccgaacgggaaaccaacctaagtttagtaacgttaccgttagggacctaaaacgttacggaaaacctaaacccgttacggaaaccggaacccccgggaaacgggaacccggtaaccggggttagttaagtttaaacgtttcgttacggaccggtaccgggaacgtagggtaacgggttacggggggtttaccttaccggggttttccggggtttaccgggggtttacccgtttttacccggttttaacggg

SEQ ID NO: 362317 - DNA, 802 bp, Homo sapiens
  misc_feature: GZ8MTXP02GUKVD.45.39.D06.1.454.CMB.2.raw
  modified_base (280)..(280): a, c, t, g, unknown or other
  modified_base (297)..(297): a, c, t, g, unknown or other
  modified_base (309)..(309): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctcctgtgagcgcctggactcaccttnagtggctatcggccttnacgtgggtcccncgtacggtttcccagggccgaagggggtctaggggtacggttggggtttcggcgttagtaacgttagttagtggggttaatggaagttggggaagtaacggtaaccttaaaccgtcgttttacggacctaacggtacccgttacccgggtaggggaaccggggtacccgtaacgtttacccgaacccgtaacgtacccgacccgtaaacgtacgaaccgtaacgttaccgaaacgggaacctaaccgtaagttacgttacgttacgtacgggtactaaacgttacgaaaccgtaaccgtacgaaacggaacccggtaaggtaccggtaacggggttacgttaacgtttacgtttaccggtacggtaccggtacgggtaacggtaacgggttacggggtttccggggggtttacctttaacccggggttttacgggggtttaaccccgggggttttacccgtttttaccgggtttaaacggttttacccggggg

SEQ ID NO: 362318 - DNA, 644 bp, Homo sapiens
  misc_feature: GZ8MTXP02ITXGC.45.39.D06.1.454.CMB.2.raw
  modified_base (251)..(251): a, c, t, g, unknown or other
  modified_base (317)..(317): a, c, t, g, unknown or other
  modified_base (570)..(570): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagcttgggttttcctcgttgctcttttaagaggtgtccagtgtcgaggtggaagtggtgcgaggtccgggggagcgtggtccagccgtgggagtccctgacnctctctgtgagcgcctggactcaccttcgagtggctagtcggcccttaccgacgtcggggtccccnccgtaggttccccagggccgaaggggtctggggtagttcgggttggcgtgatagtagtggtatggatcgggagtaagaactaacgactttagaccgtagaccgttccggaggacggggaccgtattccgacctacgtccgacccgaagtaacgaactaaacgttaccgaaaggaaaccacttaacttagtacttcgtacggactaaatacgaaacaacgtacgacgaccgaggacgacggtagtatatttcgngcgtacgagtacgtaggttcggggttactaccggtttcgggttaccgggtttaccttttacgtttacgtacggg

SEQ ID NO: 362319 - DNA, 583 bp, Homo sapiens
  misc_feature: GZ8MTXP02F85S6.45.39.D06.1.454.CMB.2.raw
  modified_base (306)..(306): a, c, t, g, unknown or other
  modified_base (352)..(352): a, c, t, g, unknown or other
  modified_base (530)..(530): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtccctgacactctcctgtgagcgctggactcacctcagtggctatcggccttcacgtgggtccncgtacggtccaggcgaaggggctggagtggtgctgatatagtgtangatggagagaactatcttgctagacctcggtgggacggggcctagtccacagtacgacccagacgaactaacttaccgaaaggaacactaacgttgtaattcgtaggactaagtacgaaaccaacgtaggaaccgaccggaaggacgtacgggtagtattacgttctggcgacgtagnggtaggtggggttactcggtttcgggttccggttaccgtttacgttgttacgg

SEQ ID NO: 362320 - DNA, 578 bp, Homo sapiens
  misc_feature: GZ8MTXP02FLX6W.45.39.D06.1.454.CMB.2.raw
  modified_base (288)..(288): a, c, t, g, unknown or other
  modified_base (434)..(434): a, c, t, g, unknown or other
  modified_base (460)..(460): a, c, t, g, unknown or other
  modified_base (518)..(518): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcagggtggaagtggtgcaggtccgggggaggcgtggtccaggccgtgggacggtccctagacactctcctgtgaacgcgcctggactcaccttnagtgctatggccttgactcggccgccgtaggttcccaggcgaaggggctacgggaggtgggttgcgtgaattagtatggtatgagtggaagagactaaacagtttgactagacctcggtaggacggggcgtatcacatcgacaganacatacaagaaacactatcgtatacnggtacaaagtacaacaaccgtagacgaaccgagaacgtacgggtattatagttaccgngcgacgagagtaaggttacgggttacgttacggttacggttaccggttacctttcgtacg

SEQ ID NO: 362321 - DNA, 613 bp, Homo sapiens
  misc_feature: GZ8MTXP02GA0PD.45.39.D06.1.454.CMB.2.raw
  modified_base (246)..(246): a, c, t, g, unknown or other
  modified_base (306)..(306): a, c, t, g, unknown or other
  modified_base (374)..(374): a, c, t, g, unknown or other
tcagacgcgatcgacacgaccggtgctcgatttagtgacatctcgcagttctttgggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggagtcccngacactctcctgtgagcgctggactcaccttcagtggctatcggccttcactgggtcccnccgtaggttcccagggcaaggggctgggagtggttgctgatatagtggtatgagtggagagactaacncgtttgacagaccgtccggtgggacgggccgtattccgacctatccgaccagacgactaaacttaccgagaaccactaattgtaactcgttaggaccaatacgaaactaacctacgaacgacccgaaggacgtacgggtagtacttagttccgtagaccgtacgaggaggtacgggttgggggtttaccttacggtttacgggttaccggggtttaccttttacgtttacgttacgggg

SEQ ID NO: 362322 - DNA, 654 bp, Homo sapiens
  misc_feature: GZ8MTXP02JNVRF.45.39.D06.1.454.CMB.2.raw
  modified_base (343)..(343): a, c, t, g, unknown or other
  modified_base (363)..(363): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggagtccctgacactctcctgtgagcgctggactcaccttcagtgctatcggccttcactgggtcccgcctaggttccaggcaaggggctgggagtggttgctgatagtntggtatgatggagagactanctttgacgtagacgtccgtaggacggggccattccacctatccgaccagacgactaacgttaccgaagaacaactagtttagtaacgtcgtacgggactaaagtacgaaaacctaacccgtaggaaaccggaaccccggaagggaacccgaacgggggttattaacgttaacgtttccggtaaggccggaaggtaacggtaaggtaacgggttcgggggtttaccgttaacccggttttcgggggttaccggggtttaacccttttttccggtttaaacgtttcccggggg

SEQ ID NO: 362323 - DNA, 652 bp, Homo sapiens
  misc_feature: GZ8MTXP02J0HWE.45.39.D06.1.454.CMB.2.raw
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcggtggtccaggcctgggaggtccctgacactctcctgtgaagcgcctggactcaccttcagtggctagtcggccctttacgacgttcggggtcccgccgtaacgggtttcccgaagggccgaaagggggccttggggaggttggttcggctggattagtagttcggtagtgtagtcggagaagactaaactcgtttgacgagtacctcggtacgggaggggcccgtagttcacccacgtccgaccagacgaacaacttaccgagaaccactattagtactcgtaggactaagtacgaaacgaaccgtacgaaccggacccgaacggaccgagggtagttacgttattcgtacgccgtacggacgaggtaggttcgggggttactaccggtttcggttacccggggttccttttaccggtttacttacggg

SEQ ID NO: 362324 - DNA, 563 bp, Homo sapiens
  misc_feature: GZ8MTXP02JUAH7.45.39.D06.1.454.CMB.2.raw
  modified_base (183)..(183): a, c, t, g, unknown or other
  modified_base (251)..(251): a, c, t, g, unknown or other
  modified_base (305)..(305): a, c, t, g, unknown or other
  modified_base (357)..(357): a, c, t, g, unknown or other
  modified_base (364)..(364): a, c, t, g, unknown or other
  modified_base (374)..(374): a, c, t, g, unknown or other
  modified_base (385)..(385): a, c, t, g, unknown or other
  modified_base (399)..(399): a, c, t, g, unknown or other
  modified_base (405)..(405): a, c, t, g, unknown or other
  modified_base (484)..(484): a, c, t, g, unknown or other
  modified_base (489)..(489): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctcttttaagaggtntccagtgtcaggtggaagtggtgcgaggtccgggggaggcgtggtccagccgtgggacgtccctgacnctctctgtgagcgctggactcacttcagtgctatcggccttcacgtgggtcccnccgaggttcccaggcgaaggggctagggacgtggtggctagatatgtcgtangatgganagactacgtnttgcagctcgngacgggcatcacancacganacgactaactccgaagaacactagttatagtcagacgaatacgaactacgagacggaccgacggacgacggtagtactnttcgngtcggacgaggtaggtcggttaacgggggtctttacggttcggggttacgggttccttttacggttagttcggg

SEQ ID NO: 362325 - DNA, 610 bp, Homo sapiens
  misc_feature: GZ8MTXP02GCK85.45.39.D06.1.454.CMB.2.raw
  modified_base (250)..(250): a, c, t, g, unknown or other
  modified_base (254)..(254): a, c, t, g, unknown or other
  modified_base (403)..(403): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtgggacgtcccngacnctctcctgtgaacgcgcctggactcaccttcagtcggctagtcggtcctttcgacgttcgggtaccaccgtacggttcccgaggcgaagggggtctagggaggttgggttgctagattagtagtggtatgagtggaagagactaaactnttgactagtactcggaggacgggctactcacactcgacagacgacaataccgaacgaacactatagtatcgaggacaagacgaacaacgtacgaccggaccgaggaaccgtacggtactagttacgttcgacgtcggacgaggtaggtaagggttcggggttaccttacggttcggggtttaccggtttaccttttacggtttacgg

SEQ ID NO: 362326 - DNA, 599 bp, Homo sapiens
  misc_feature: GZ8MTXP02G5LCZ.45.39.D06.1.454.CMB.2.raw
  modified_base (285)..(285): a, c, t, g, unknown or other
  modified_base (301)..(301): a, c, t, g, unknown or other
  modified_base (375)..(375): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggaagtggtgcaggtccgggggagcgtggtccagccgtgggacgtccctgaccactctcctgtgaagcgcctggactcaccttnagtgctatcggccttnacgtgggtccgcctaggttccaggccgaaggggctagggagtggttggctgatatagtggtatgagtggaaganacgtaaacacgtttgacagacgtccggtaggacgggccagtacgaccagtcgaccagagacaactaccgaagaacacgtagttagtatcgtaggacaacgtacgaaacaaccgtaggaaccgacccgaggtaacgacggtagtacgttacttacgtacgcgtacgagaggtaaggtacgggggttactacggttacgggttcgggttaccttttacgtttacgg

SEQ ID NO: 362327 - DNA, 608 bp, Homo sapiens
  misc_feature: GZ8MTXP02F3B0C.45.39.D06.1.454.CMB.2.raw
  modified_base (182)..(182): a, c, t, g, unknown or other
  modified_base (253)..(253): a, c, t, g, unknown or other
  modified_base (264)..(264): a, c, t, g, unknown or other
  modified_base (279)..(279): a, c, t, g, unknown or other
  modified_base (378)..(378): a, c, t, g, unknown or other
  modified_base (430)..(430): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagnggtgtccagtgtcaggtggaagtggtgcaggtccgggggaggcgtggtccagccgtgggacgtccctgacnctctctgtgancgctgactcaccttnagtggctagtcggtccttcacgtcggtccgccgtacggttccaggcgaagggggctgggagttcgggtgctgatatagtgtatgatggagagactaaancgtttagctaagactccggaggacggggtccgattcgaccatccgacacganactaatacgacgaaacactagttacgtatcgtaggtacaaagtacgaaaccaacgtagaaccggaaccgaacggacgtaacgggttattaagttacttgtcggacgtacgaggaaggtaagggttcgggggttacgtttacggttcgggtttaccgggttacctttttcgtttacggg

SEQ ID NO: 362328 - DNA, 583 bp, Homo sapiens
  misc_feature: GZ8MTXP02G294R.45.39.D06.1.454.CMB.2.raw
  modified_base (256)..(256): a, c, t, g, unknown or other
  modified_base (284)..(284): a, c, t, g, unknown or other
  modified_base (390)..(390): a, c, t, g, unknown or other
  modified_base (406)..(406): a, c, t, g, unknown or other
  modified_base (501)..(501): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggaggcgtggtccagccgtgggacgtccctgaccnctctcctgtgaagcgctggactcacctnagtgctagtcggccttcgacgtcgggtccgccgtaggttcccgaggcgaaggggctagggaggttggttggcgtagatatagtggtatgatggagagactaaactnttgactagcgtccggnggacgggctagtcacgactcgacagagaacaacgtaccacgaaacactattgtatcgtggacaatagaactacgagacgaccgagacgtacggtntactagtttcgacgcgtacgagtaggtggtcgggggtttacgttacggtttcgggttaccggtttccgtttacgtttacggg

SEQ ID NO: 362329 - DNA, 622 bp, Homo sapiens
  misc_feature: GZ8MTXP02JJWGU.45.39.D06.1.454.CMB.2.raw
  modified_base (312)..(312): a, c, t, g, unknown or other
  modified_base (381)..(381): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggaggcgtggtccaggccgtggggacgtccctgacactctctgtgagcgcctggactcaccttcagtggctagtcggccttcacgtcgggtccnccgtaggttccaggcgaaggggctgggaggtggttggctgatagtatggtatgatggagagactaactnttgacagacctcggtagacggggacgtatacgacactcgccagacgaacaacgtaccgaagaacactattgtaactcgtagactaaagtacgaaacaaccgtaggaacgacccggaggaacgacgggttacgttaacgtatttcgtacggcgacggaacggaggtacgggttcgggggttacttaccggtttacggggtttacccggggtttacctttttaccggtttaaggtttccgggg

SEQ ID NO: 362330 - DNA, 745 bp, Homo sapiens
  misc_feature: GZ8MTXP02GCD0U.45.39.D06.1.454.CMB.2.raw
  modified_base (252)..(252): a, c, t, g, unknown or other
  modified_base (281)..(281): a, c, t, g, unknown or other
  modified_base (312)..(312): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagccgtgggacggtccctgacnctctcctgtgagcgcctggactcaccttnagtggctagtcggccttcacgtcgggtcccnccgaggttcccaggccgaaggggctggagtggtgctagatatagtggtatgagtcggaagtacgtaactaacgtctttggacctaacgtaccgtaccgggtagggaacgggggtccctaactttacccgaaccctagtcccggacccgaaagtaaccgtaaactaaacgttacccgaaacggaaacctaacgttaaagtttacggtaacttacgtacggtaactaaacgtaacgaaaacctaacccgtaaggaaaccgaacccgggaacgggtaaccgtaacggggttattacgtttagttttaccggacggtaccggacggtaaagggtacggttaacgggggtttcgggggtttacccgtttacccggggttttcgggggttttacccggggttttaaccgtttttacccggtttaaggtttacccggggg

SEQ ID NO: 362331 - DNA, 634 bp, Homo sapiens
  misc_feature: GZ8MTXP02I8TN9.45.39.D06.1.454.CMB.2.raw
  modified_base (247)..(247): a, c, t, g, unknown or other
  modified_base (360)..(360): a, c, t, g, unknown or other
  modified_base (365)..(365): a, c, t, g, unknown or other
  modified_base (413)..(413): a, c, t, g, unknown or other
tcagacgcgatcgacacgaccggtgctcgatttagtgacatctcgcagttctttgggggctggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccggggagcgtggtcagccgtgggacgtcctgacnctctcctgtgagcgcctggactccaccttcgagtggctagtcggtccttcacgtgggtcccgcgtacggttcccaggccggaaggggcgtggaggttggttggctgatagtgnggtangagtacggagtagaactactcgttgacagtactcggtagggacgggcnttccacacgtcgcagagactaacgtaccgagaacactattagtactctaggactaaacgcgtaaaccaaccgttacgaccggtaacccggaagggaccggaacggtagttagttacgtttcgacgccggttaggaacggtaaggtacgggttcgggggtttaccgttaaccggggtttcgggttacggggtttaccttttacggttacggtttaccggggg

SEQ ID NO: 362332 - DNA, 651 bp, Homo sapiens
  misc_feature: GZ8MTXP02G9367.45.39.D06.1.454.CMB.2.raw
  modified_base (250)..(250): a, c, t, g, unknown or other
  modified_base (264)..(264): a, c, t, g, unknown or other
  modified_base (292)..(292): a, c, t, g, unknown or other
  modified_base (302)..(302): a, c, t, g, unknown or other
  modified_base (356)..(356): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccgggggagcgtggtccagccgtgggacgtccctgacnctctcctgtgagcnctggactcacttcagtgctatcgccttnacgtggtccnccgtaggtccaggcgagggctggagtggttgctgtatatagtgtatgagtgganagaactactcttgacagtacgtccggtaggacggggacgtataccacactcgaccagacgaactaactacgaacgaacacgtattacgtactacgtacgggactaaactacggaaacctaaccgtaggaaccggtaacccgggaacggtaaccggtagggttaacgttaacgtttacgtttacgtacggacggtacggaacgggttacggtaggggttaaccgggggtttacgttaaccgggttttcggggtttacccggggtttaccctttttaccggttaggtttaaccgggg

SEQ ID NO: 362333 - DNA, 748 bp, Homo sapiens
  misc_feature: GZ8MTXP02JK757.45.39.D06.1.454.CMB.2.raw
  modified_base (305)..(305): a, c, t, g, unknown or other
  modified_base (351)..(351): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcaggtccggggagcgtggtccagccgtgggacgtccctgactactctctgagacgcgctgactcacttcagtgactagtcggccttcacgtgggtccncgtacggtccgaggcgagggctggagtggtgctagatatagtgtangacgtaggagtaacaacgttaagtcgtttgacgtaacgtaccgtcgggttagggaccggggtacccgtaacgttacccgacccgtaacgtacccggaacccgaacgtaaaccgaaacctaaacgttaacccgaaacggtaaactaaaccgttagtttagtaacgttcgtacgggtaacctaaagtaaccgtaaaaccgtaacccgtacggtaaaccggaacccggaacgggtaacccgtaagggggttaaccttaaggtttacgtttacggtacggtacccggtacggtaacgggtaaggttaccggggtttaacgggggtttaccctttaccgggggtttacggggtttacccggggttttaacccgtttttaccggtttaacggtttacccgggg

SEQ ID NO: 362334 - DNA, 721 bp, Homo sapiens
  misc_feature: GZ8MTXP02FPKLK.45.39.D06.1.454.CMB.2.raw
  modified_base (279)..(279): a, c, t, g, unknown or other
  modified_base (287)..(287): a, c, t, g, unknown or other
  modified_base (296)..(296): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggagtggtgcgaggtccgggggagcgtggtccaggccgtgggacggtccctgacactctcctgtgagcgctgactcacttnagtgctancggtccttnacgtggtccgcgtacggttccaggcgaaggggtctggggagttgggttcggctagtattagtagtggtatgaacgttggaagaacgtacctaaaacgtcgtttagaccgtaacggtaccgtccgggtagggtaccgggggtcctaacgttccgaacccgtacgttacccgaccgtaacgaacgtaaacctaacgttaacccgaacggtaaacctaacgttagtttacgtaacgtccgttagggaacctaaacgttaacgggaaaacctacgtaacggaccggtaaaccccggaagggtaaccgtaacggggtagttacgttacgttacgtcggaccggtacggaggtacggtaacggggttacgggggtttaccttaaccgggttcgggggtttacccggttacccgtttttacggtttaacggg

SEQ ID NO: 362335 - DNA, 720 bp, Homo sapiens
  misc_feature: GZ8MTXP02FX1N7.45.39.D06.1.454.CMB.2.raw
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccggggagcgtggtccagcctgggaggtccctgacactctcctgtgaagcgcctggactcaccttcagtggctatggcctcactgggtccgcaggttccaggcaaggggctgggagtggttggctgatatagtggtatgagtggaagagtacctaaacactttgacagactccggtaggaggggtccgtattacaccgaatccgacccaagaacgaaacctaaattaccccgaagggaaaaccaaccgtaaatttacggttaaattaccgttaggggacctaaacgtacgtaaaaccgaaacccgttacggaaacggaaaccccggaaacggggtaaaccggtaaccgggggttagttaaacgtttaaacgtttaccgttaacggtcccggaccgggtaagggtaaacgggtaaacgggtttacggggggggttttaccgttaaaccccgggttttcggggttttacccggggggtttaaccccgtttttaccccggtttttaaacgg

SEQ ID NO: 362336 - DNA, 582 bp, Homo sapiens
  misc_feature: GZ8MTXP02J0WOI.45.39.D06.1.454.CMB.2.raw
  modified_base (252)..(252): a, c, t, g, unknown or other
  modified_base (371)..(371): a, c, t, g, unknown or other
  modified_base (388)..(388): a, c, t, g, unknown or other
tcagacgcgatcgacacgaccggtgctcgatttagtgacatctcgcagttctttggggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagccgtgggagtccctgacnctctctgtgaagcgcctggactcaccttcagtggctatggccttcactggtccgcaggttccaggcaaggggctgggagtggttggctgatatatggtatgagtggagagtactaaacntttgactagactccggnggagggccgtattcacatcgcagagacaacttaccaggaacactactgtatctgggacaatacgaacaaccgtgacgacccggaaggacgtacgggtgtacgtacttcgtacgcgccgtaaggacggtaacggttcgggggttacttacccggtttgggttacccggggtttaccgttttaccgttttaacggg

SEQ ID NO: 362337 - DNA, 616 bp, Homo sapiens
  misc_feature: GZ8MTXP02H46RT.45.39.D06.1.454.CMB.2.raw
  modified_base (247)..(247): a, c, t, g, unknown or other
  modified_base (258)..(258): a, c, t, g, unknown or other
  modified_base (277)..(277): a, c, t, g, unknown or other
  modified_base (390)..(390): a, c, t, g, unknown or other
  modified_base (541)..(541): a, c, t, g, unknown or other
  modified_base (549)..(549): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggacgtccngacactctccngtgagcgcctggctcactnagtgctagtcggccttcacgtcgggtcccgccgtaggttcccgagggacgaaggggctgggaggttggttggctggaatagtagtggtatgagtaggataagtactaaaactntttcgacagtaccgtccgtagggacgggccagttacaccagtccgacaggatacgaatccgaaaggacaaactattagtatacgtagacaaatagaaacctaaccgtaggaaccgaaccgacggaacgtacgggtattagttacgttacgnggtaccgnggtaaggacgtaagggttcggggttactaccggtttggggttaccggtttaccgttttacttacggg

SEQ ID NO: 362338 - DNA, 622 bp, Homo sapiens
  misc_feature: GZ8MTXP02FK3IT.45.39.D06.1.454.CMB.2.raw
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggagcgtggtccagccgtgggaggtccctgaccactctctgtagagcgcctggactcaccttcagtggctagtcggtcccttcacgtcggggtccccgccgtacgggtttccccagggaccgaagggggctggggtaggttgggttgggtctggatagttatggtatgagtaggaagagaactactatttgacagacctcggtaggaggggccagttccaccatccgacctagacaacaacttaccgagaacactattgtatcgtggacaagtacgaaactaacctgaacgacccggaaggtaccgacgggtagtattatttcgtgacgacgaggtagtagggttcgggggttacttaccggtttcgggttaccggtttaccgttttccgtttagtttaccgggg

SEQ ID NO: 362339 - DNA, 595 bp, Homo sapiens
  misc_feature: GZ8MTXP02I658Q.45.39.D06.1.454.CMB.2.raw
  modified_base (186)..(186): a, c, t, g, unknown or other
  modified_base (252)..(252): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagctgggttttcctcgttgcttcttttaagaggtntccagtgtcaggtggaagtggtgcaggtccgggggagcgtggtccaggcctggggagtccctgacnctctcctgtgaagcgctggactcaccttcagtggctagtcggccttcgacgtcgggtcccgccgtaggttcccaggcgaaggggctgggagtggttggctgatagtatgtatgagtggaagagactaaactacgtttgactagtactccggtggacggggccgagttccaacgactccgaccagacgacaactaccgaaggaacactattacgtatctcggacaatacgaacactagacgaccgaggacgtacgggtatagttacttcgtacgcgtacgaggacgtaaggttcgggggttaccgttacgttcggggttaccgggttaccgttttcgtttacgg

SEQ ID NO: 362340 - DNA, 694 bp, Homo sapiens
  misc_feature: GZ8MTXP02I9ZIO.45.39.D06.1.454.CMB.2.raw
  modified_base (305)..(305): a, c, t, g, unknown or other
  modified_base (346)..(346): a, c, t, g, unknown or other
  modified_base (360)..(360): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggagcgtggtccagccgtgggagtccctgacactctcctgtgagcgctggactcacttcagtgctagtcggccttcacgtcgggtcccnccgtaggttccaggcgaaggggctggagtggtgctgatatntggtatgagtgganagactaacgtcttgacagtacctcggtaggacggggctacgttcaccagtccgacaagacgaactaacgttaccgaacgaaacacgtatttacgtaacgttacgtacgggaactaaacgtaacgaaacctaaaccggtacggaaaccgggtaaccccgggaaacgggtaaaccggtaaaccgggggttacttaaagtttaacgttttacccggaggttacccggtacggaaacggtacgggttaggggttaacgggggtttaccgtttaaccggggttttcgggggtttaaccgggggtttaccctttttttaccggttaagggtttcccgggg

SEQ ID NO: 362341 - DNA, 721 bp, Homo sapiens
  misc_feature: GZ8MTXP02IXDEX.45.39.D06.1.454.CMB.2.raw
  modified_base (279)..(279): a, c, t, g, unknown or other
  modified_base (296)..(296): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccggggaggcgtggtccagccgtgggagtccctgacactctctgtgagcgcctgactcacttnagtgctatcggccttcncgtcggtccgccgaggttccgacggcgaggggcgtgggaggtggttggcttggatattagtggtagtagagtggaagaacgtactaaactacggtttacgaccgacgtaccgtccggggtagggacgggggtccgtaacgttccaaccgtacgtacccgaccgaaggaacgaaccctaaacgttacccgaaacggaaactaacctagtttacgtaagttccgtagggtaactaaacgtacgtaaaaccgtaccgtaacggaaaccggaacccgggtaaacggaaccggtaacgggtacgtttaagttacgtttacgtacggtccggtaacggtaagggtaacgggttaacggggtttacgggggtttaccgttaccggggtttccggggtttacccggggtttacgtttttacccggtttacggg

SEQ ID NO: 362342 - DNA, 605 bp, Homo sapiens
  misc_feature: GZ8MTXP02I1VTA.45.39.D06.1.454.CMB.2.raw
  modified_base (252)..(252): a, c, t, g, unknown or other
  modified_base (282)..(282): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgtcttcttttaagaggtgtccagtgtcaggtggaagtggtgcgaggtccgggggaggcgtggtccagccgtgggagtccctgacnctctcctgtgacgcgcctggactcaccttnagtggctagtcggccttcacgtgggtccgccgtaggttccaggcgaaggggctggagtggttgcgtgatagtagtggtatgagtggagagactaatctttgactagacctcgggagggagggtccgattccaccactcgaccagacgacaacttaccgaagaacatacttagtactacgtacggacaaagtacgaaaccaacgtacggaacgacccggaaggacgtacgggtacgtattaacgttcgtagcgtacgaagtcggtaggttggggttccgttacggtttcggggttccggttaccgttttcgttacgtttaccgg

SEQ ID NO: 362343 - DNA, 645 bp, Homo sapiens
  misc_feature: GZ8MTXP02H1OL6.45.39.D06.1.454.CMB.2.raw
  modified_base (310)..(310): a, c, t, g, unknown or other
tcagacgcgatcgacacgaccggtgctcgatttagtgacatctcgcagttcttttgggggtctggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccggggagcgtggtccagccgtgggagtccctgacactctcctgtgagcgcctggactcaccttcagtggctatcggccttgaccgttggggtcccnccgtacggttcccgaggtcgaagggggtctgggagttggttggctagatatgtggtatgatggaagagtaactaacgtctttgaccgtagtaccgtccggtagggacggggcccgtagttaccaacgacgtcgaccgagaacgactaacgttaccgaagaactaacgtattacgtaatcgtaggactaaagtacgaaaccaacgtacggaacgaaccggaggaacgtacgggtattaacgttacgtttctacggacgacggtagtaggtaggttgggggttaccttaacggtttcggggttaccgggtttacctttttaccggtttagttacggg

SEQ ID NO: 362344 - DNA, 606 bp, Homo sapiens
  misc_feature: GZ8MTXP02IE8KO.45.39.D06.1.454.CMB.2.raw
  modified_base (257)..(257): a, c, t, g, unknown or other
  modified_base (286)..(286): a, c, t, g, unknown or other
  modified_base (339)..(339): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggaagtggtgcagggtccgggggaggcgtggtccaggccgtgggacgtccctgacnctctcctgtgagcgcgtggactcaccttnagtgctagtcggtccttcagtcggtccgctacggtccaggcgaagggctgggnggtggtggctgatagtagtgatgagtggagacgtactaaactacgtttgactagacctcgggtaggacggggccgtacttaccacgatcgaccagtagacctataccgagaacactattgtatcgtggacaatacgaaacctacgacgtacgaccgaaggtacgtaacggtagtactacgtttcacggcgtacggtacgtaggtaacgggttcgggggtttacttaccgggtttacgggtccgggtttaccttttcgtttaacgggg

SEQ ID NO: 362345 - DNA, 566 bp, Homo sapiens
  misc_feature: GZ8MTXP02GI61T.45.39.D06.1.454.CMB.2.raw
  modified_base (312)..(312): a, c, t, g, unknown or other
  modified_base (469)..(469): a, c, t, g, unknown or other
  modified_base (524)..(524): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggagcgtggtccagccgtgggacgtccctgactacgtctcctgtgaagcgcctggactcacttcagtggctatcggtccttcacgtggtcccncgaggttccaggcgaaggggctgggagtggttgctgatatagtggatgagtggagtacgtactaactacgttgaccagtacgttcggagggacgggtctactccacactcgactagacgaactacgtaccgagaaactctagttagtatccggtaanactaacacgaacacgacgaccgacgtagtacgtacgtatactctacgcgtcgagngagtgggtcggtacttacggttcggtacgtttacctttgtgg

SEQ ID NO: 362346 - DNA, 715 bp, Homo sapiens
  misc_feature: GZ8MTXP02GC1E5.45.39.D06.1.454.CMB.2.raw
  modified_base (247)..(247): a, c, t, g, unknown or other
  modified_base (266)..(266): a, c, t, g, unknown or other
  modified_base (278)..(278): a, c, t, g, unknown or other
  modified_base (311)..(311): a, c, t, g, unknown or other
tcagacgcgatcgacacgaccggtgctcgatttagtgacatctcgcagttctttggggtctgggagaggagcccagcactagaagtcggcggtgtttccattcggtgatcagcactgaacacagaggactcaccatggagtttgggctgagcttgggttttcctcgttgctcttttaagaggtgtccagtgtcaggtggaagtggtgcaggtccgggggaggcgtggtccagccgtgggacgtcccngacactctctgtgagcgcnggactcaccttnaggtgctatcggtccttacgacgtcgggtcccnccgtaggttcccgagggtacggaaggggtccgtgggtacgggttgggttaggcgtaagattagtagtggttaatggacgttagggagtaaacgaaactttaaacctcgtttcgacacgggtaccttacgggtggggacggggtacccgtagttacccgaacccgtaacgttcccgaacccgaaggtaaccgtaaacgaaaccgtttaccgaaaacggtaacaaacgttaacgttagtaacgtcgttaggacaacgtaacgaactacgtacgacggacccgtaggacgtaacggtagtttaacgtctttacgcggacgtaccggaggtacggttaacgggttcgggggttaccgttaccggtttacgggggttaccggtttaccgttttcggtttacggtcgggg

SEQ ID NO: 362347 - DNA, 665 bp, Homo sapiens
  misc_feature: GZ8MTXP02JRQY3.45.39.D06.1.454.CMB.2.raw
  modified_base (246)..(246): a, c, t, g, unknown or other
  modified_base (306)..(306): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagtcttgggttttcctcgttgcttcttttaagagtgtccagtgtcaggtgaagtggtgcaggtccgggggagcgtggtccaggccgtgggacgtcccngacactctctgtgacgcgctggactcaccttcagtggctagtcgccttcacgtcggtccnccgtacggttcccgaggaccgaaggggctggagtgggttgctgtatatgtggtatgacgtaggagacgaacttaaccgtgtttagcgtagtacgtccggtagggacggggtcccgtagttacccaaccgtacgtacccgaccgtaacgaacgtaacctaaacgttaccgaaacggaaacctaacgttagttacggtatccgtagggaacctaaagttacgaaacctaaccgtgaaaccggaccggaacggtaacgtaccgggttattaaacgttcttacgtcgaccggtacgtacgaggtaggttcggggttacttaccggttacggggttacccggtttactttccggttagtcgggg

SEQ ID NO: 362348 - DNA, 625 bp, Homo sapiens
  misc_feature: GZ8MTXP02HTOYB.45.39.D06.1.454.CMB.2.raw
  modified_base (250)..(250): a, c, t, g, unknown or other
  modified_base (293)..(293): a, c, t, g, unknown or other
  modified_base (299)..(299): a, c, t, g, unknown or other
  modified_base (308)..(308): a, c, t, g, unknown or other
  modified_base (375)..(375): a, c, t, g, unknown or other
tcagacgcgatcgacacgaccggtgctcgatttagtgacatctcgcagttctttgggggctctgggagaggagcccagcactagaagtcggcggtgtttccattcggtgatcagcactgaacacagaggactcaccatggagtttgggctgagcttgggttttcctcgttgcttcttttaagaggttgtccagtgtcaggtggaagtggtgcaggtccgggggagcgtggtccagccgtgggacgtcccngacactcgtcctgtgaagcgcctggactcacttcagtgctagngccttnactggtccnctaggtccaggcaggggctggagtggttgctgatatactggtactgatggaacgagtacttaaaacnctttgaccaagaccgttccggtaggacggggacctattacccaaccagtccgaccaaggaactaacaacttacccgaaggaaactaaacctaattgtaactacgtacgacaacgaacgaacgaacgaacgaacgaccgaacggaacggaacggtacggttacgtacgttacgttacgtacgacgacggagtaaggtacgggttacggttacggttacggtttaccgggtttaccggttttaccgtttacg

SEQ ID NO: 362349 - DNA, 667 bp, Homo sapiens
  misc_feature: GZ8MTXP02H6SEH.45.39.D06.1.454.CMB.2.raw
  modified_base (248)..(248): a, c, t, g, unknown or other
  modified_base (278)..(278): a, c, t, g, unknown or other
  modified_base (284)..(284): a, c, t, g, unknown or other
  modified_base (383)..(383): a, c, t, g, unknown or other
  modified_base (399)..(399): a, c, t, g, unknown or other
tcagacgcgatcgacacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgctctttttaagaggtgtccagtgtcaggtggaagtggtgcgaggtccgggggagcgtcggtccagccgtgggacgtcccngacactctctgtgaacgcgccgtggactcnccttangtcggctagtcggtccttcgacgtcgggtcccgcgtacggttccgacgggacgaggggtctggaggttgggttggctagatagtgtggtatgatggganagaactaacgtcttanacgagtacgtcggtagggcgggtccgtatccaccgtacgtcccgacgtaagaactaacgtaacgtaccgagaactacttaagtttacggtacttacgtacggtactaaagtaccgaaaccgtaaccgtacggaaaccgaaccccggagtaaccggtacgggtattacgttagtttcgacggacgtacggaagaggttcggggttcggggttaccgttaaccggtttcggggtttaccggtttaccgtttttacgttacggttaccggg

SEQ ID NO: 362350 - DNA, 645 bp, Homo sapiens
  misc_feature: GZ8MTXP02I9E8D.45.39.D06.1.454.CMB.2.raw
  modified_base (185)..(185): a, c, t, g, unknown or other
  modified_base (309)..(309): a, c, t, g, unknown or other
  modified_base (371)..(371): a, c, t, g, unknown or other
  modified_base (385)..(385): a, c, t, g, unknown or other
tcagacgcgatcgacacgaccggtgctcgatttagtgacatctcgcagttctttggggctggggagaggagcccagcactagaagtcggcggtgtttccattcggtgatcagcactgaacacagaggactcaccatggagtttgggctgagcttgggttttcctcgttgcttcttttaagaggtntccagtgtcaggtggaagtggtgcaggtccgggggagcgtggtccagccgtgggacgtccctgacactctctgtgacgcgctggactcacttcgagtgtctatcggaccttcacgtcgggtccncgtacggttccaggcgaaggggctggagttgggttcgctgatagtactggtatcgatcgganaacgaactaacgtnttgactacgtaccgttacggaggacgggggtacctacgttaccaactacgtccgaccgaaggaacaacgtaacttaccgaaacggaactaaactagtttagtactacggtacggtacaaaacgtaacgaaactaaccgtagaaaccgacccggtaaggacgtaacggggtatattacgtttcgagacgacggacggtaggtacgggttcgggttaccgttacggttacgggttaccggtttaccttttcgttacggtcgg

SEQ ID NO: 362351 - DNA, 648 bp, Homo sapiens
  misc_feature: GZ8MTXP02G9EVS.45.39.D06.1.454.CMB.2.raw
  modified_base (164)..(164): a, c, t, g, unknown or other
  modified_base (183)..(183): a, c, t, g, unknown or other
  modified_base (249)..(249): a, c, t, g, unknown or other
  modified_base (276)..(276): a, c, t, g, unknown or other
  modified_base (281)..(281): a, c, t, g, unknown or other
  modified_base (285)..(285): a, c, t, g, unknown or other
  modified_base (292)..(292): a, c, t, g, unknown or other
  modified_base (299)..(299): a, c, t, g, unknown or other
  modified_base (317)..(317): a, c, t, g, unknown or other
  modified_base (353)..(353): a, c, t, g, unknown or other
  modified_base (366)..(366): a, c, t, g, unknown or other
  modified_base (373)..(373): a, c, t, g, unknown or other
  modified_base (383)..(383): a, c, t, g, unknown or other
  modified_base (396)..(396): a, c, t, g, unknown or other
tcagacgcgatcgacacgaccggtgctcgatttagtgacatctcgcagttcttgggggctctgggagaggagcccagcactagaagtcggcggtgtttccattcggtgatcagcactgaacacagaggactcaccatggagtttgggctgagtcgtggtttccncgttagctctttaagagtntcagtgtcaggtggaagtggtgacaggtccgggggagtcgtggtccagccgtgggacgtcctgacncgtctctgtgagcgctggactcacctnagtgntagngccttangtcggcncgaggtccaggcaagggntgggagtcggtgctgatagatggtatgaacgtgganaacgttaaacgtnttcgacngtacgtcggngacgctagtcacncgcgacgagagacacgtacgaacgaactacgtagttacgtacgtacgtacgaactaaacgaccgaaacgtaccgtaaacggaacccggtaaacccgggaacgggtaaaccggttacgggttacgttaacgttaaccggttacccggaggtacccgacgggtaacggtaacgggttaacggggttacccgggggtttaccgttaaccggggtttacggggttacccgggtttacccgttttacgggtaaacgg

SEQ ID NO: 362352 - DNA, 619 bp, Homo sapiens
  misc_feature: GZ8MTXP01CEW2O.19.2.A02.1.454.CMB.2.raw
  modified_base (279)..(279): a, c, t, g, unknown or other
  modified_base (338)..(338): a, c, t, g, unknown or other
  modified_base (342)..(342): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctagtggtgggttccttcagtaggttactacgtggagttggactccgcacgccccgagggaggacnggagtggagttagggaatcaatcagtaggtggaagcgcagctaccgaacccgtccctanaagngtcgctcgactatatagacgacacgaacccaagcgtctaacgttctcccgtagaacgtcgtcgggctcgtgtcgcccgccgccgacgacggtctgtcttattcgtgtcgacggtaggtagttggaattgttggtcgtggttggggtggttaagtccgtgtccgtaaccggtccggttcgttttacgacgtttaacgggtcttacggggttcgggggttaccgtaacgggtaaccccggttggtaccccgtaccggttcctccccgttcgtaaccccg

SEQ ID NO: 362353 - DNA, 721 bp, Homo sapiens
  misc_feature: GZ8MTXP01EN872.19.2.A02.1.454.CMB.2.raw
  modified_base (93)..(93): a, c, t, g, unknown or other
  modified_base (284)..(284): a, c, t, g, unknown or other
  modified_base (322)..(322): a, c, t, g, unknown or other
tcagtactctcgtgcacgaccggtgctcgatttagactcatctacagggggctttctgagagtcatggacctcctgcacaagaacatgaaacncctgtggttcttcctcctcctggtggcagctcccagatgggtcctgtcccaggtgcagctacagcaggtggggcgcaggactgttaaagccttcggagaccctgtccctcacctgcgctgtctagtggtggtccttcgagtagttactacgtggagttggactcccgccgacggccccgaggggaaggcgnggaggtggagttagggaaatcaatcagtagtaggaacncggacagactaccgaaccccgtccctagaacgacgtcggactacgactactagttagacgaccaccgaacccaaggtaacgtctaacgttccctaccgtaggaacgtcgttaggggccttcgtacggtcggaacccggtcccgaccggaaccgaccggtcttcgttcttaacgtttcgtacggtcggtacggggtagttaggggtttaggtatttagttggttcggtcgggtttggggttgggttaacggcgtttacgggtcccgttaacccgggtcccggtttcggttttacgttaacggtttacggtaacccggtttagggttccgggggttaccgtaaccgggggtaaaccccgttcggtacccgtacccggttccttaaccccttcgtaaccccg

SEQ ID NO: 362354 - DNA, 588 bp, Homo sapiens
  misc_feature: GZ8MTXP02IJH9P.19.2.A02.1.454.CMB.2.raw
  modified_base (227)..(227): a, c, t, g, unknown or other
  modified_base (580)..(580): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtgggcgcaggactgttaaagccttcggagaccctgtccctcacctgcgctgtctatggtggtccttnagaggttactacgtggagttggactcccgccacgccccgagggaaggctggagtggagtggggaaatcgaatcagtagtggaagcgaccagctaaccaaccccgtccctacaacgacgtccggctacgactataagttagtacgacaccgacccaaagagtcctagttcctaccccgtagaacgcgtcgggctcgtgtcggacccgcccggaccgacgaccggtctcgtccttatttctaggttgacgagtagttggattagttgtgtctgggtgtagctgctacgcgttcgtttcaagttacgtacgtacggtgggtacgaacgggtaaccctggtacccacgttcctaccncgtacccg

SEQ ID NO: 362355 - DNA, 559 bp, Homo sapiens
  misc_feature: GZ8MTXP02HW90T.19.2.A02.1.454.CMB.2.raw
  modified_base (370)..(370): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctatggtggtccttcagaggttactacgtggagttggatcccgcagccccgaggaggactggagtggattggggaaatcgaatcagtagtggaagcgaccagctacaaccccgtccctacaagagtcggctcgacatattagtagacacgcccaagngtcagttctccctagaacgctgggctgtgtcgaccgccgccgacaccggtctgtcctattcgtgtgcgagtagttggattgttgtgtcgttgggtgtagcgtagctacggtccgtcgtttacgagtttacgacgttacggtggggacaacggggtaacccttgggtaccaccggtcctccgtcgacccg

SEQ ID NO: 362356 - DNA, 519 bp, Homo sapiens
  misc_feature: GZ8MTXP02GSH3C.19.2.A02.1.454.CMB.2.raw
  modified_base (365)..(365): a, c, t, g, unknown or other
  modified_base (410)..(410): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctatggtgggtccttcagaggttactactggagttggatccgccagcccccaggaggactggagtggattggggaaatcaatcagtagtggaagcgccagctacaacccgtccctcaagagtcggctcgacatatagtagacacgcccaagngtcagttctccctgaacgcgtgggctctgtcgaccgccgccgacncggctgtctattctgtgcgagagttgattatgtgctggtgtagctgctacgccgtgtttcagttacgactacgtgggtcaagggaccctggtcaccgtctccgtcaccg

SEQ ID NO: 362357 - DNA, 572 bp, Homo sapiens
  misc_feature: GZ8MTXP02H94L9.19.2.A02.1.454.CMB.2.raw
  modified_base (376)..(376): a, c, t, g, unknown or other
  modified_base (406)..(406): a, c, t, g, unknown or other
  modified_base (440)..(440): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctagtggtgggtccttcagtaggttactacgtggagttggatcccgccacgcccccgagggaggactggagtggatggggaaatcaatcatagtggaagcgaccagctaaccaacccgtccctacaagcgtcggctcgacatattagtagacacgacccaagngtctagttcctccctagaacgctgggctcngtcgaccgccgccgacacggctgtcttattctgngcgagtagttggatagttgtgcgtggtaggtgcgtggcctacggccgttacgtttcaaggtttacgacgtacggttcggggttcgaacgggggtaaccccttgggtaccacccggttctccgttacgacccg

SEQ ID NO: 362358 - DNA, 539 bp, Homo sapiens
  misc_feature: GZ8MTXP02GS62M.19.2.A02.1.454.CMB.2.raw
  modified_base (166)..(166): a, c, t, g, unknown or other
  modified_base (208)..(208): a, c, t, g, unknown or other
  modified_base (329)..(329): a, c, t, g, unknown or other
  modified_base (507)..(507): a, c, t, g, unknown or other
  modified_base (524)..(524): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtgggcncaggactgttaaagccttcggagaccctgtccctcacctgcnctgtctagtggtggtccttcagaggttactacgtggagttggatccgcacgccccgaggaggactggacgtggagtagggaaatcgaatcatacgtgaagcgcagctacacccgtccctanaagacgtcgctacgacacgtatagtacgacacgacccaagcgtcacgttccacccgttgaacgcgtagggcctcgtgtcgaccgccgaccgacgacggctgtctattctgtgcgtagtagtggatgtgtgcgtgtgtagcgtgctacgccgtgttcgaagttcgacgtacgtcgggtnaacgggtacctggtacnccgtctcctctaccg

SEQ ID NO: 362359 - DNA, 616 bp, Homo sapiens
  misc_feature: GZ8MTXP02ITYK1.19.2.A02.1.454.CMB.2.raw
  modified_base (167)..(167): a, c, t, g, unknown or other
  modified_base (228)..(228): a, c, t, g, unknown or other
tcagtactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcncaggactgttaaagccttcggagaccctgtccctcacctgcgctgtctatggtggtccttnagaggttactactggtagttggatccgccacgccccgagggaggactggagtggagttaggggaaatcaatcatagtggaagcgcagctaaccacccgtccctacaagacgtcgctcgactatattagtagacacgacccaagcgtactacgttcctaccctgaagtcgtgggctcgtgtcgacccgccgacccgacaccgggtcttcgttaccttactttccgtggtcgtcggaggttacggttgggtattacgttggtcgtcgttagggtggtaggtctgccgttaccggccggttacgtttcgaaaggtttacgtaccgttacggtcggggtaccgaacggggtaaccccttgggtaccctaccggttcctaccgtacgtacccg

SEQ ID NO: 362360 - DNA, 577 bp, Homo sapiens
  misc_feature: GZ8MTXP01BH9GC.52.65.F10.1.454.CMB.2.raw
  modified_base (271)..(271): a, c, t, g, unknown or other
  modified_base (383)..(383): a, c, t, g, unknown or other
  modified_base (543)..(543): a, c, t, g, unknown or other
  modified_base (554)..(554): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggcgggcagtcaggtttgttagcgtcctggttacgcctggtatcagcagaaaccagggaaacncccctaaagtcctggtctatgctacatcctaatttgacaaagtcggcgtcccctagaacggttccgcggcagtggatcgtggactaaaattcaactctcacatcagcagctncagcctagaagtagttttgacgtactttacgtattcgtacaacggtagggggggttaactaggtttttacccgtacgttaccgtttcgggaccgtaagggggtaacctaaggtcgttagggacctaagtaaccgaaaacgttacgttagttcggctcgcncccttatcgtntccttcacttcctcccgctaacg

SEQ ID NO: 362361 - DNA, 684 bp, Homo sapiens
  misc_feature: GZ8MTXP01CYINV.52.65.F10.1.454.CMB.2.raw
  modified_base (656)..(656): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagagtcaaccattctacgttggtcgggacgtaggtcgtagggttgttaggccgtaccgttgggttacgccgttagggtatcgaagacgaaaggaaaaccgaacggggaaaccgtaccccgttaaaagtccgtggtactagtgactaacactacctaatttcgacgtaaaggtcggtcccgtccccgtagaacgggttccgcggacgtaggtggactcggtaggaacttaaaatttccaacttcctacaaccctagtaccacggctaacgcctgacctacgtccgtaggtaaacgtatttttcggaccgttaacttacttagtcgtaacgtaacggtaggggggttaacctttacggttttacccgaacttaccggtttggaacccgtaggggtaacctagtacgtagggaactacgtaacgaaacgttacgtcgttacggtctacgaccttccttatccgttntccttacacgttcccttcccgcttaacg

SEQ ID NO: 362362 - DNA, 682 bp, Homo sapiens
  misc_feature: GZ8MTXP01CHD1Z.52.65.F10.1.454.CMB.2.raw
  modified_base (191)..(191): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccagggtgccaggtgcgacatccagatgacccagtctccatcttccgtgtctgcatctgtagganacagagtcaccatcagttggtcgggcgtagtcgtagggttgttacgcgtccgtgggttagccgtggtatcgagacaagaaaccgagggaaaccgtacccgtaaagtccgtggtactagtcgactaacatacctaatttgactaaagtcggccgtaccccgtagtaacggttccgacggctaaggtggagttcgtagggtaactaaaaactttccaactcctacaacctactcgacgcacgtccctggaccaggacctagtaagttacgttttcggacttacttaactagttacgtacgtaaacggttaggggggtaacttacggtttccgtaacgttaccggtttaggacccggtaagggggtaacctaaggccgttacggtaacaacgttaaccgaaaacggttgtcggttacgggaccttacggaccttaccgttacgttccttccgttctttaacccgtactttccccggtttaaccccgccgttaag

SEQ ID NO: 362363 - DNA, 575 bp, Homo sapiens
  misc_feature: GZ8MTXP01CJE3S.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcagggttgttagcgtcctggttagcctggtatcagacaagaaaccgagggaaacacccctaaagtcctggtctatgctacatacctaatttgactaaagtcggccgtcccctagaacggttccgcggcacgtggatcgtagggaactaaaaactttcaactctacaaccatcaagcagccctgcacgctagtaagtatttcgactaactttatattacgtacaacggtagggggttacttacgtttccgtactcgttcgaccgtagggaactagcgtagactataacaaacgttacgtgcggtactcgacttaccattcgtcgttaaccttcgtacttcccgtccccgaaccttaag

SEQ ID NO: 362364 - DNA, 609 bp, Homo sapiens
  misc_feature: GZ8MTXP01CR01D.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagagtcaccatcacttggtcgggcgagtcagggttgttagcgtcctgggttacgcctggtatcagcaagaaaccgaagggaaacgacccctaaagtcctggtctatgctacatccaatttgactaaagtcggccgtcccctacgaacgggttcccgcggcgtaggtggatcgtagggaactaaaaatttcaactctcaaccatcagcagcctgcagcctagaagtattttcgacgtaactttactattacgtactaaacgtacggggggttacttacggttttaccgacgttaccgtttgggacccgtaaggggtaacctaagtcgttacggaactaagtaacgaaaacgacgttggttcggactgaccgttccttaacgttctacgttccttacacttcccttcccgcccttaag

SEQ ID NO: 362365 - DNA, 601 bp, Homo sapiens
  misc_feature: GZ8MTXP01B2MTA.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttgtagcgctggtagcctggtatcagcagaaaccagggaaacgccctaaagtcctggtctatgctacatccaatttgacaaaggtcggccgtcccctcaacggttccgcggcgagtggatcgtgggactaaaatttcaactctcaccatcagcacgcctgcagcctagaagtatttcgacgtacttacgtattgtactaacgtacggggggttacttacggttttaccgttaccgtaccgtttcgggacccgtagggggtacctaaggtcgtacgggactaagtaacgtaaaacggttaaccgttggttacgggtcctcggaccgttcccttaacgttcccttggttcctttcaacttaccttccccgttcccttaacg

SEQ ID NO: 362366 - DNA, 625 bp, Homo sapiens
  misc_feature: GZ8MTXP01C7M7C.52.65.F10.1.454.CMB.2.raw
  modified_base (191)..(191): a, c, t, g, unknown or other
  modified_base (245)..(245): a, c, t, g, unknown or other
  modified_base (272)..(272): a, c, t, g, unknown or other
  modified_base (291)..(291): a, c, t, g, unknown or other
  modified_base (322)..(322): a, c, t, g, unknown or other
  modified_base (331)..(331): a, c, t, g, unknown or other
  modified_base (358)..(358): a, c, t, g, unknown or other
  modified_base (367)..(367): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctagtagganacagagtcaccatcacgttggtcggcgtagtctagggttgtagcgtcgtggtancgtgtatcagcaagaaaccgaggaacnccctaaagtccgtgtctancgctacatacctattgacaagtcgcctcccngacgtccgngcagtggatcgtaggactaaaacttcnctctacacntacagcagcctacgcgacgtcagtaagttacttttcgacgttaacttacttagttcgtaacgtaaacggttaacgggggggttactttaccggttttacctaaccgtacggtttcggaccgaagggggtaaactacggtcgtacggaactaacgtaaacaaaacggttaccttggacggtactacggacccgttaaccttacggttcccgttagttcccctttacgtaccgttccccgtttaacccgaactttaaacc

SEQ ID NO: 362367 - DNA, 536 bp, Homo sapiens
  misc_feature: GZ8MTXP01B2R9X.52.65.F10.1.454.CMB.2.raw
  modified_base (190)..(190): a, c, t, g, unknown or other
  modified_base (360)..(360): a, c, t, g, unknown or other
  modified_base (518)..(518): a, c, t, g, unknown or other
  modified_base (523)..(523): a, c, t, g, unknown or other
  modified_base (536)..(536): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtagganacagagtcaccatcacttggtcgggcagtcaggttgttagcgtcctggttagcctggtatcagcaagaaacagggaaacaccctaaagtcctggtctatgctacatccaatttgacaaagtcgcgtcccctagaacggttccgcgcagtggatcgtggactaaaatttcnctctacacatcagctacgcctgcagcctagaagtatttcgacgtacttactattcgtacaacgtaggggggtacttagttttccgactccgtttggacctaggggtactaaagctaggactataacgaaacgacgtgttacggctgcttaccatcctntctcncttcctcccgctn

SEQ ID NO: 362368 - DNA, 985 bp, Homo sapiens
  misc_feature: GZ8MTXP01CD9TG.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacgttggtcggggactagtcgtagggtttgttacgcgtccgttgggttacgccgttggtatcgaagacaaacggaaaaccgaacggggaaaaccgtaccccttaaaaggttcccgttagggtaccttaagtcgtaccttaactaacttacccgtaaagttttacggaaccgtaaacgggttccgggtaccccgtttacccccggttaccggtaaacggggtttccccggacggggtaccgtaacggggttcgggtaaacgttacccgggttaacgggggtaaaaccctttaaaaaaaaccgttttttcccgaacccgtttacccgtttaaaccccgaaaacccctacggtttaaaccccgaaacggggcctaaacccgggtccccgtttacggacccggtaacggttaccccgtttaaagggtaaaaccggtttttaacggttttttaccgggaaccggttttaaacccgttttaaccttaaagggttttacccggttaaaccggttaaaaccggggtttaaacgggggggggggggttttaaaccctttttaacccgggggtttttaacccctttaaaccccggtttacccggggtttacggggtaaccccggggttaaggggggtaaacctttaacggggaccgtttacgggaaaccttaaacggtaaaccgtaaacgggttaacgtcgggttaccgggtactcggttaaccgttaccttacgtttccggttacgttaacccgttcttaaccttccccggttaaccccgcgtttaaccg

SEQ ID NO: 362369 - DNA, 550 bp, Homo sapiens
  misc_feature: GZ8MTXP01EW01R.52.65.F10.1.454.CMB.2.raw
  modified_base (508)..(508): a, c, t, g, unknown or other
  modified_base (511)..(511): a, c, t, g, unknown or other
  modified_base (520)..(520): a, c, t, g, unknown or other
  modified_base (529)..(529): a, c, t, g, unknown or other
tcagcgcagtacgacacgaccggtgctcgatttagctacgctctaaggggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcacatcacgttgcgggcgagtcaggttgtagcgcctggttacgccgtggtatcagacaagaaaccgagggaaacgaccctaaagtcctggtactatgctacatacctaatttgacgtaaagtcggccgtccccgtagtaacgggttccgcggcgtacggtggatcgtaggaactaaaactttcaactctacaccatcagctacgctgcagctagtagttatttcgactacttatattgtacaacggtagggggtacttacgtttccacgtacgttggaccgtagggactagctagacataacaaacgttntgngactcgacncttatcgtntcttactcttcctccgctaac

SEQ ID NO: 362370 - DNA, 788 bp, Homo sapiens
  misc_feature: GZ8MTXP01CBA9D.52.65.F10.1.454.CMB.2.raw
tcagcgcagtacgacacgaccggtgctcgatttagctacgctctaaggggggagtcagacccagtcaggacacagcatggacatgagggtccccgctcagctcctggggctcctgctgctctggttcccaggtgccaggtgcgacatccagatgacccagtctccattcttccgtgtctgcatctggtaggagacagagtcaaccattcacgttggtcgggcgtaggtcgtaagggtttgttacgcgtccgttgggttagccgttggtatcaggacaaacggaaaccgacgggtaaaccgacccgtaaagtccgtaggtctatgactacacttacctaatttcgaacgtaaacggttccgggtacccgttacccccgtacggtaaaccggggttcccggacgggtacgtaaccgggttacgggacgttaccggtaacggggtaaaaccctttaaaaaaccttttaccctaaccttaccctacccgaaaccctaactaccgtaacggtaccctaccggacccgttacgaccgtacggtacccgttaggtaaacgtttacgttttacgaccgtttaacttacttacgttacgtacgaaacgggttacgggggttaactttacggtttacccgtacgttccgtttcgggaccgtaggggtaactacggtacgtacgtaactaacgttaaaccgaaacgttcgtcgggttacgtccgtacgttaccgttaccttactttccgttcggttccttaccttacccgttacccgttaaccccgaacgtttaacccg

SEQ ID NO: 362371 - DNA, 671 bp, Homo sapiens
  misc_feature: GZ8MTXP01CHFOD.52.65.F10.1.454.CMB.2.raw
  modified_base (463)..(463): a, c, t, g, unknown or other
  modified_base (496)..(496): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagactcaccatcacgttggtcgggcgtagtcgtagggttgttacgcgtccgttgggttacgccgttggtatcgaaggacgaaacggaaaaccgaaggggaaaccgtacccctaaaggtcccttaggtactagtcgactaactacttacctaaagtttcggaactaaacggttccggtacccgttccccgtacggtaacgggttcccggcgggtactacgggtggacttcggtaacgggtaaaccttaaaaactttccaactcctacaaccntacgacgcacgtcctgacaggtctagtaagttntttcgacttacttatagttacgacgaacggttacgggggttacttacggtttccgacgttccggttcggaccggtaagggtacctaggtcgtaaggtaccaagtaaccgtaaacgttcgttgacggtcctagaccgttcttactgttcttcttacacttcctaaccgttctaacg

SEQ ID NO: 362372 - DNA, 605 bp, Homo sapiens
  misc_feature: GZ8MTXP01BM8VK.52.65.F10.1.454.CMB.2.raw
tcagcgcagtacgacacgaccggtgctcgatttagctacgctctaaggggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagatcaccatcacttgcgggcagtcaggttgtagcgtcctgggttagccgtggtatcgagacaagaaaccgagggaaacgaccctaaagtcctggtctatgctacatacctaaatttgactaaaggtcggaccgttccccgtacgtaaacggttccgcggcgtaggtggatcgtagggaactaaaaatttcaactctacaccatcagctacgcctgacagctagtaagtacgttttgactaacttactattagtacgtaacggtaggggggttacttaggttttaccgactaccgtttggaccgaggggtaactaaggtctaggactaactaacgaaaacgttcgtaggttcggtctggaccttaccgttattcctacgttccttacctacttcccgtttccccgcgttaac

SEQ ID NO: 362373 - DNA, 629 bp, Homo sapiens
  misc_feature: GZ8MTXP02GXYNN.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggtcgggcgagtcaggttgttagcgtcctggttagcctggtatcagcagaaaccagggaaacgcccctaaagtcctggtctatgctacatccaatttgcaaaagtgcgtcccctcaaggttccgcggcagtggatctagggacaaatttcactctcaccatcagcagcctgcagcctagaagtattttgcgtaacttactattgtacaaacgtagggggtaactaggttttcccgtaactaccgtttacgggacccgtagggggtaacttaaaacggcgttacggggaaactaacttaaccgaaaaaccggtaaaccgttcgggttaaggggaccttcgggtaccccaaaccccgtaaagtttaacccttacgggtttccttttaccgaacctttccctttccccccggaccctttaaacg

SEQ ID NO: 362374 - DNA, 531 bp, Homo sapiens
  misc_feature: GZ8MTXP02GU6Y7.52.65.F10.1.454.CMB.2.raw
tcagcgcagtacgacacgaccggtgctcgatttagctacgctctaaggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttgttagcgcctggtagcctggtatcagcagaaaccagggaaagcccctaaagtcctggtctatgctacatccaatttgcaaaagtggcgtcccctcaaggttccgcggcagtggatctgggacaaatttcactctcaccatcagcagcctgcagcctgaagtatttgcgtacttactattgtacaacaggggtacagtttccgtacacctttggaccaggggactaagctagggacattacaaaacgtactaggtcggctcgacaccctaatcctggttccttacacttccgttaccccgtcccttaac

SEQ ID NO: 362375 - DNA, 525 bp, Homo sapiens
  misc_feature: GZ8MTXP02HMXV2.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcagtcaggttgtagcgcctggttagcctggtatcagcagaaaccagggaaagcccctaaagtcctggtctatgctacatccaatttgcaaaagtggcgtccctcaaaggttccgcggtcagtggatctgggacaaatttcactctcaccatcagcagcctgcagcctgaagattttgctacttactattgtacaaacgtagggggtactaggttttccgtactacctttggccgtaggggacttaaagccgtggacattacgaaaacgtaactggtaggctcgcaccatcctgtcttcatcttcccgactac

SEQ ID NO: 362376 - DNA, 548 bp, Homo sapiens
  misc_feature: GZ8MTXP02IJ3WH.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttgttagcgcctggttagctggtatcagcaagaaaccagggaaacgacccctaaaagtccctaggtacctaatgacttacatacctaaatttgactaaaagtggccgttacccctacgaaacggttcccgacggcaggtggatcgtaggggaactaaactttcactctacaccatccagcagcctgcagcctgaagtatttgactacttatattgacaaactagggtactagtttccataccttggccagggactaagctaggacagtacaaaacgtaactgtacggctacgacaccatctgtctttacacttccttcccactaac

SEQ ID NO: 362377 - DNA, 610 bp, Homo sapiens
  misc_feature: GZ8MTXP02JX1W6.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcagtcagggttgttagcgcctggttagcctggtatcagcagaaaccagggaaagcccctaaagtcctggtctatgctacatccaatttgacaaagtggcctcccctcgaaggttccgcggcagtggatcgtgggacaaatttcactctcaccatcagcagcctgcagcctgaagtatttgcgtacttactattgtactaacgtaggggttactacgttttaccgtacctaaccgtttcgggacccgtaagggggtaaccttaaacggcgttacggggaacctagttaaaccgaaaaaccggtaaaccgtgggttacgggccgttacggacccgtaacccctattcccgtcggtttccctttacgtacctttccccgtttacccccggcctttaaccg

SEQ ID NO: 362378 - DNA, 506 bp, Homo sapiens
  misc_feature: GZ8MTXP02F6HS9.52.65.F10.1.454.CMB.2.raw
  modified_base (490)..(490): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggcgggcagtcaggttgttagcgcctggttagcctggtatcagcagaaaccagggaaacgcccctaaagtcctggtctatgctacatccaatttgcaaagtggcgtccctcaaggttccgcggcagtggatctagggactaaatttcactctcaccatcagcagcctgcagctagaagtatttgctacttactattgtacaaacgaggggtactagtttccgtactacctttggccaggggactaagctagacatacaaagactgtagctgacacatcgttntctcactcctccacta

SEQ ID NO: 362379 - DNA, 520 bp, Homo sapiens
  misc_feature: GZ8MTXP02HLSQA.52.65.F10.1.454.CMB.2.raw
  modified_base (225)..(225): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttntagcgcctggttagcctggtatcagcagaaaccagggaaagcccctaaagtcctggtctatgctacatccaatttgcaaagtggcgtccctcaaggttccgcggcagtggatctgggacaaatttcactctcaccatcagcagcctgcagcctgaagtattttgcgtacttactattgtacaactagggggtactagttttcccgtactacctttggccgtagggggacttaaaggccttagggacagttcaaaacgaactgtggctgcaccatctgtcttcattcctccgctac

SEQ ID NO: 362380 - DNA, 543 bp, Homo sapiens
  misc_feature: GZ8MTXP02IAA3S.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcggcgagtcaggttgtagcgcctggtagctggtatcagcaagaaaccagggaaacgcccctaaagtcctggtctatgctacatccaatttgacaaagtggccgtcccctcgaacggttccgcggctagtggatcgtaggggactaaatttcactcctacaccatcagcagccctgcagcctagaagtattttgcgtaacttactattgtacaagtaggggtacttagttttaccgtactaccgtttggtacgaggggtactaaaggtctaggacaagtacaaaacgagtcgtggctagactacctatcgttctcttactatccttccgactac

SEQ ID NO: 362381 - DNA, 544 bp, Homo sapiens
  misc_feature: GZ8MTXP02JYUYE.52.65.F10.1.454.CMB.2.raw
  modified_base (361)..(361): a, c, t, g, unknown or other
  modified_base (515)..(515): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggtcgggcgagtcaggttgtagcgcctggtagcctggtatcagcagaaaccagggaaacgcccctaaagtcctggtctatgctacatcaatttgcaaagtcggcgtcccctctaacggttccgcggcacgtggatcgtaggggactaaattcnctctacaccatcagcagcctgcagcctagaagtatttgcgtaacttactattcgtactaaacgtagggggtactacggttttaccgtactaccgtttcggaccgaggggtactaaggcgtaggacaatacaaaacgactggtagctacgcaccngtaactcgtacttcactccttcccgctac

SEQ ID NO: 362382 - DNA, 553 bp, Homo sapiens
  misc_feature: GZ8MTXP02F9LDJ.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggtcgggcagtcaggttgtagcgcctggttagctggtatcagcagaaaccagggaaacgcccctaaagtcctggtctatgctacatccaatttgacaaagtggccgtcccctcaacggttccgcggcagtggatcgtgggacaaatttcactctcacatcagcagcctgcagcctagaagtatttgacgtactttactattgtacaaacgtagggggttaactaggttttcccgtacgtaccgttttcgggacccgtaagggggtacctaaaggctagggaacagtacaaaacgtactggtcggctcgacacctatccgtgtaccttcacttcctcccgactacg

SEQ ID NO: 362383 - DNA, 581 bp, Homo sapiens
  misc_feature: GZ8MTXP02HDWG2.52.65.F10.1.454.CMB.2.raw
  modified_base (371)..(371): a, c, t, g, unknown or other
  modified_base (557)..(557): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagatcaccatcacttggtcgggcgagtcagggttgttagcgtccttgggttagcctggtatcagcaagaaaccgagggaaacgcccctaaagtcctggtctatgctacatcctaattgactaaagtcggccgtccctacgaacggttccgcggtcaggtgatcgtaggaactaattcnctctcacctatcagcacgtcctgacacgcctagtaagtactttgacgttacttaactattcgtaacgtaacggtacggggttacttacgtttacccgtacgtaccgtttcgggaccgtacgggggtaactaaggtcgtacggacaacgtaacgaaacgtacgtaggtcgctcgacctactatcgtntaccttcacttccgtcccactacg

SEQ ID NO: 362384 - DNA, 551 bp, Homo sapiens
  misc_feature: GZ8MTXP02G9097.52.65.F10.1.454.CMB.2.raw
  modified_base (350)..(350): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcagtcaggttgttagcgcctggttacgctggtatcagcaagaaaccagggaaacgacccctaaagtcctggtctatgctacatccaatttgacaaagtcggccgtcccctcgaacggttccgcggcaggtggatcgngggaactaatttcactctcaccatcagcagcctgcagctgaagtatttgcgtacttatattgtacaacgtaaggggttactagttttcccgtactaccgtttcgggaccgtaagggggtactaaggtcctgggtaaccacgttaacaaacgtaatggtcggctacgacacctatccttgtcttacactcccttaccgctac

SEQ ID NO: 362385 - DNA, 606 bp, Homo sapiens
  misc_feature: GZ8MTXP02IUW59.52.65.F10.1.454.CMB.2.raw
  modified_base (190)..(190): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtagganacagagtcaccatcacgttggtcgggcagtctagggttgtagcgtcctggttacgcctggtatcagcaagaaaccgagggaaacgacccctaaagtcctaggtctatcgctacatcctaattgacaaagtcggccgtccctacgtaacggttccgcggcgagtggactcgtagggaactaaactttcactctacaccatcagcagcctgcagcctagtaagttatttcgacgttaacttactattcgtacaaacggtagggtacttagttttacccgacttaccgttggaccgtaaggggtactaaacggtcgtaggaactaacgtaaccgtaaaacggtaaaccgttggtacggtccgtacgtaccaccgtacttctacgttccttactacttcccgttacccggactttaaccg

SEQ ID NO: 362386 - DNA, 531 bp, Homo sapiens
  misc_feature: GZ8MTXP02JHSHG.52.65.F10.1.454.CMB.2.raw
  modified_base (235)..(235): a, c, t, g, unknown or other
  modified_base (263)..(263): a, c, t, g, unknown or other
  modified_base (396)..(396): a, c, t, g, unknown or other
  modified_base (497)..(497): a, c, t, g, unknown or other
  modified_base (505)..(505): a, c, t, g, unknown or other
tcagcgcagtacgacacgaccggtgctcgatttagctacgctctaagggggagtcagacccagtcaggacacagcatggacatgagggtcccgctcagctcctggggctcctgcttctctggttccaggtgccaggtgcgacatccagatgacccagtctccatcttccgtgtctgcatctgtaggagacagatcacatcacttgtcgggcagtcaggttgttagcgctggttancctggtatcagcagaaaccagggaaacnccctaaagtcctggtctatgctacataccaatttgactaaagtggccgtcccctacgaacggttccgcggcaggtcggatcgtagggaactaatttcaactctacacatcagcagccctgcagcctagaagtntttgcgtaacttactattgactaaacgaggggttactagtttaccgactaccgtttggaccaggggtactaagctaggacatacaaaacgactgtcggacncgacactntctgtctactactcctaccactactc

SEQ ID NO: 362387 - DNA, 554 bp, Homo sapiens
  misc_feature: GZ8MTXP02HTQTW.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcagtcaggttgtagcgctggttagcctggtatcagcagaaaccagggaaacgcccctaaagtcctggtctatgctacatccaatttgacaaagtggcgtccctcaaaggttccgcggcagtggatcgtgggactaaatttcactctcaccatcagcacgcctgcagcctagaacgtattttgcgtacttactattgactaaacgtagggggttactagttttcccgtaactaccgtttgggacccgtaagggggtactaaaggcttagggaacaacttacgaaaacgtaactgtacggactcgaccaaccatcctgtcttacacttccttacccgcctacg

SEQ ID NO: 362388 - DNA, 672 bp, Homo sapiens
  misc_feature: GZ8MTXP02GO4TT.52.65.F10.1.454.CMB.2.raw
  modified_base (268)..(268): a, c, t, g, unknown or other
tcagcgcagtacgacacgaccggtgctcgatttagctacgctctaagggcgagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcgagtcaggttgtagcgtcctggtagcctggtatcagcaagaaaccgaggaaacncccctaaagtcctaggtctatgctacatcctaatttgacaaaggtcggccgttccccctacgtaacggttccgcggaccaggtgtagtcgtagggtaacctaaagtttccaacttctaccaccactcgacgcacgcctgcacgcctagtaacgttatttcgacgtaacttacttaagtttacgtacgtaaacggtagggggtttaccttacgggttttacccgtaacttacccgtttacgggacccgtaggggtaacctaaggtcgtaacggtaactaacgttaaaccgaaaacggtaaacgttcgggtacggtaccgttacggaacccgttaaccctaacgttacccgttcggttttaccccttaccgttaaccgtttccccctttaccccggtttaaccccg

SEQ ID NO: 362389 - DNA, 551 bp, Homo sapiens
  misc_feature: GZ8MTXP02F2JL7.52.65.F10.1.454.CMB.2.raw
  modified_base (225)..(225): a, c, t, g, unknown or other
  modified_base (266)..(266): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcagtcaggttntagcgcctggttagcctggtatcagcagaaaccagggaaancccctaaagtcctggtctatgctacatccaatttgcaaaagtggcgtcccctcaacggttccgcggcagtcggatctagggacaaaatttcactctcaccatcagcagcctgcagcctgaaagtatttgcgtattactattgtacaaactagggggttacagttttaccgtactacctttggccctaagggggtacctaaaggcctagggacctaatacaaaacggaactgttgggccttaggacaccaatccgttcgtacttacctacgttcctacccgactac

SEQ ID NO: 362390 - DNA, 535 bp, Homo sapiens
  misc_feature: GZ8MTXP02GGAX3.52.65.F10.1.454.CMB.2.raw
  modified_base (268)..(268): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgcgggcagtcaggttgttagcgcctggttagcctggtatcagcaagaaaccagggaaacncccctaaagtcctggtctatgctacatccaatttgacaaagtggccgtccctacgaacggttccgcggcagtggatcgtagggactaaatttcactctacaccatcagcagcctgcagcctgaagtatttgacgtacttactattgtacaaacgtaggggttactagttttcccgactaccgtttcggaccgtaggggacttaaagctaggactatacaaacgaactgtggactcgacacctatctgtcttacacttcctccgacta

SEQ ID NO: 362391 - DNA, 537 bp, Homo sapiens
  misc_feature: GZ8MTXP02IUTHN.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggcgggcagtcaggttgttagcgccttggttagcctggtatcagcagaaaccagggaaagcccctaaagtcctggtctatgctacatcctaatttgacaaagtggcgtcccctcgaacggttccgcggcagtggatcgtagggactaaatttcactctcaccatcagcagcctgcagcctgaagtattttgacgtaacttactattgtacaacgtaggggttacttagtttccgtactacccgtttggcccgtagggggactaaagtcgtaggacatacaaacgtaactggtggactgaccaccatctgtcttcactccttccgactac

SEQ ID NO: 362392 - DNA, 667 bp, Homo sapiens
  misc_feature: GZ8MTXP02GM93P.52.65.F10.1.454.CMB.2.raw
  modified_base (277)..(277): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggtcgggcgagtcgtaggttgttagcgtccttggttacgcctggtatcagcaagaaaccgagggaaacnccctaaagtcctggtactatgctacactcctaatttagacaaagtcgggccgtacccctacgtaacgggttccgcggtcgaacggttggacttcggtacggggaaactaaactttccactcctaccaacctatcaacggcaacggccctgacgacgaccctaggtaaagttacgtttcggacttaactttaacttacgttcgtaaaccggtaaacggtaacgggggttaacttaaccggtttttaccgtaaccgttacgtttacgggaccggtaaaggggtactaaaggtccgtaaggtacacgttaaacgaaaacgtaacgtcggtacggccttaggaccctaacgtcttaacgttcgtaccttactactttccgtacccactttaacg

SEQ ID NO: 362393 - DNA, 709 bp, Homo sapiens
  misc_feature: GZ8MTXP02HA1J8.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccagggtgcgacatccagatgacccagtctccatccttccgtgtctgcatcgtggtaggagacagacgtcaaccatcacttggtcggggcgagttcgagggttgtagccgtcctgggttacgcgtggtatcagcaagaaaccgaagggaaacgcccctaaagtccgtggtctatgactaacatacctaatttgacgtaaaggtcgggtcccgtaccccgtacgtaaacggttcccggacggtcgaagggttcggacgttacggtaggggaaaccttaaacgtttccaccttaccttacaaccctagtaccacgacacgtcctacgaccacggtccgtagtaaagtttagttttcggacctttaacgtttaacttagtttacgtaacgtaaaccggtaaggggtttacctttacgggtttacccgttaccgttaacccggtttcgggaacccggtaacgggggtaaacttaacggacgttacgggaactaacgtaaaccggtaaaacgtacggtagtcggtctacggacctaacgtacgttcgtcgttactacgtacttcccgttacccgtactacg

SEQ ID NO: 362394 - DNA, 641 bp, Homo sapiens
  misc_feature: GZ8MTXP02H9DL7.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaaccatcacgttgtcgggcgagtcgaggttgtagcgtccgtggttagcctggtatcagacaagaaaccgagggaaacacccctaaagtcctaggtctatcgctacatacctaaatttgaacgtaaagtcggaccgttcccctacgaacggttccgcggtcaggtggatcgtagggaactaaagtttcactctacacctatcagcacgcctgcagcctagaacgttattttacgaccgttaattaaccttagttacgtaaccgtaaaccggtaagggggttaactttaacggttttaccgttaaccgttaccggtttacgggaccggtaaacgggggtaactaaggtaccgtaggaaaccgtaagtaccgaaaaacgtcggtaagttcggactacgactaaccctattcttcgtacctttacacctttcctaccccgtctaacg

SEQ ID NO: 362395 - DNA, 556 bp, Homo sapiens
  misc_feature: GZ8MTXP02INXCV.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggcgggcagtcaggttgttagcgcctggttagcctggtatcagcagaaaccagggaaacgccctaaagtcctggtctatgctacatccaatttgacaaagtggcgtcccctacgaaggttccgcggcaggtggatcgtagggactaaagtttcactctcaccatcagcagcctgcagcctagaagtattttgcgtactttactattcgtactaaacggaggggttactacggttttacccgtactacccgtttggaccgtaggggactaaaggctaggacagtacaaacgtaacgtggtacggcttcgacctacctatcgtagttccttacacttccttcccgctacg

SEQ ID NO: 362396 - DNA, 620 bp, Homo sapiens
  misc_feature: GZ8MTXP02G46DL.52.65.F10.1.454.CMB.2.raw
  modified_base (280)..(280): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagagtcaccatcacgttggtcgggcagtcgtagggttgttagccgtccgtggttacgctggtatcgagcaagaaaccgagggaaacnccctaaagtcctggtactatcgactacatacctaatttgaacgtaaggtcggacccgttcccctacgtaacggttcccggcggcgtaggtgggacttacgtagggtaactaaactttcactctacaccatccagacacgtcctgactacgaccgttagaagttatttcggacttaactttacgtattacgtacgtaaacggttaggggttacctttacggtttcccgtaacgttaccgtttcgggaccgtaggggtaaactaggcgtaggaactaacgtaaacgaaacgacgtggtacgcgtacacctacgtatctcgttactcacttccctccactacg

SEQ ID NO: 362397 - DNA, 591 bp, Homo sapiens
  misc_feature: GZ8MTXP02I1NXL.52.65.F10.1.454.CMB.2.raw
  modified_base (237)..(237): a, c, t, g, unknown or other
  modified_base (264)..(264): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggcgggcagtcaggttgtagcgctggtanctggtatcagcaagaaacagggaaacncccctaaagtcctggtctatgctacataccaatttgacaaaggtcggccgtcccctcgaacggttccgcggcaggtgactcgtagggactaaatttcactctcaccatcagcacgcctgccagcctagaagtatttgacgtaacttactattacgtactaaacggtacggggttacttacggttttccgtaacgttaccgtttcggaccgtaagggggacctaaggtccgttaggaactacgttaacgaaaaccgtaacgtgttacgggactacggaccaacctatccttcgttccttactacgttccccgttaccgtacccttacg

SEQ ID NO: 362398 - DNA, 552 bp, Homo sapiens
  misc_feature: GZ8MTXP02F7E3S.52.65.F10.1.454.CMB.2.raw
  modified_base (214)..(214): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagatcaccatcacttgtcgggnagtcaggttgtagcgcctggttagcctggtatcagcagaaaccaggggaaacgcccctaaaagtcctggtctatgctacatacctaatttgacaaaagtcggaccgtccccctcgaaacggttccggcggtcgaggtcggatcgtacggggtaactaaaagtttcacctacctcaacctatccagcacgcctgcagcctagaagtatttgcgtacttactattgtactaacgaggggtacttagtttccgtactacctttcggacgtagggaactagcgtaggacagtacaaagactggtgctcgacaccgtatcttgtcttcactccttcccgctac

SEQ ID NO: 362399 - DNA, 559 bp, Homo sapiens
  misc_feature: GZ8MTXP02FKQ8F.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcagggttgttagcgcctggttagcctggtatcagcaagaaaccgagggaaacgcccctaaagtcctggtctatgctacatcctaatttgacaagtcggcctccctacgaacggttccgcggcagtggatcgtgggactaaagtttcactctacacatcagcagcctgcacgcctagtaagtatttcgacgtactttactagttcgtactaaacgtaggggttactacgttttccgtaacgttccgttcggaccgaggggtactaagtcgtaggacaactaacgtaaaacgtacgtgtcggactcgaccactatctcgtcttctacttccttcccactacg

SEQ ID NO: 362400 - DNA, 606 bp, Homo sapiens
  misc_feature: GZ8MTXP02JCF30.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttggtcgggcgagtcaggttgttagcgtcctggttagcctggtatcagcaagaaaccagggaaacacccctaaagtcctggtctatgctacataccaatttgactaaaaggtcggccgtcccctcgtaacggttcccgcggcaggtggatcgtaggggactaaatttcactcctacaccatcagcacgcctgcagcctagaatatttcgacgtacttactattgtacaacgtaggggttaacttcggtttacctacgttaccgtttcggacccgtaaggggtacctaaaggcgtagggtaacctaactaaaccgtaaaacggtacgtacgggtacgtacgttacgacctacctaagttccttcggtttaccttactactttccctttcccgaacctttcg

SEQ ID NO: 362401 - DNA, 602 bp, Homo sapiens
  misc_feature: GZ8MTXP02JZ9R7.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagatcaccatcacttgcgggcagtcaggttgtagcgctggttagctggtatcagcaagaaaccagggaaacacccgtaaagtcctggtctatgctacatccaatttgactaaaggtcggtccgtccccacgtaaacggttccgcggtacaggtcggatcgtagggactaaaatttcacctctacaacctatacacgcagtccctggacacgtccgtagtaaagtattttcggactaactttactagttagttacgaaaccggtaggggttaactagttttaccgacttacccgttgggacccgtaagggggaccttaaagccgtaggaactacgtaccgaaaaacgtcgtggtacgtcgtacgaccaaccctagtccttacgttctactacgttcccttacccactaacg

SEQ ID NO: 362402 - DNA, 830 bp, Homo sapiens
  misc_feature: GZ8MTXP02GR29H.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtcctccatcttccgtgtctgcatctggtaggagacagacgtcaccatcacgttggcgggcagtcgaggttgttagcgtcctggttacgcctggtatcagcaagaaaccgagggaaaccaccctaaagtcctaggtactatcgactacatacctaagtttcgacgtaaaacggtcggtacccgttacccccgttacgtaaaccggggtttcccggaccgggtccgtaagggttacgggtaacgttaccgggtaacggggtaaaccttaaaaacgtttttccaaccccgtttccttaacccgaaaccctaccgttaccgaaacgggacccaaaccggtccccgttaggacccgtaacgtaccccgttaaggtaaaacgttttacgttttaccggggtaccgtttaaactttaaccgtttagttaccggttaaaccgtaaaccgggttaacgggggtttaacctttacgggtttttaaccccgtaaccgtttaccccgtttacggggaacccgtaaggggggttaaccttaaaacggcccggttaaggtaaacccaacgtttaaaccggaaaaccggtaacgttcggtacgggaccttacgggaaccctccgtaaacgttccggttcgtaaccgtttcccgaaccgtttcccttacccccggtacccttaaacg

SEQ ID NO: 362403 - DNA, 620 bp, Homo sapiens
  misc_feature: GZ8MTXP02IYFOX.52.65.F10.1.454.CMB.2.raw
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagagtcaccatcacttggtcgggcgagtcgtagggttgttagcgtcctgggttacgcctggtatcagcaagaaaccagggaaacgacccctaaacgtcctggtcctatgactacactacctaatttgacaaaggtcggtccgtccccgtacgtaaacggttccgcgggtccaggtggactcgtaggggtaactaaactttcgcttcgtcaccatccacgcacgcctgccagtaccgtagtaaagtattttcggacgttaacttacttagttcgtaacgtaaacggtaggggttacttaacgtttttcccgtaacgtacccgtttggaccgtaggggtactaacggcgtagactagtaccaaagtaacgtcgtcggtcgtacgacctacgacttcgtcgttacttacactttacctcccgtacttacg

SEQ ID NO: 362404 - DNA, 520 bp, Homo sapiens
  misc_feature: GZ8MTXP02G9K47.52.65.F10.1.454.CMB.2.raw
  modified_base (374)..(374): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtgccaggtgcgacatccagatgacccagtctccatcttccgtgtctgccatctggtaggagacagagtcaccatcacttgcgggcagtcaggttgtagcgcctggtagcctggtatcagcagaaaccagggaaacgcccctaaagtcctggtctatgctacatccaaatttgacaaaagtcggcgtcccctcaaaggttccgcggcagtggatctgggactaaaatttcactctcaccatcancagctgcagcctagaagtatttgacgtacttactatgtacaaagaggggtactagtttccgtataccgtttggacgagggactaagctaggactatacaaaacgaactgtgctgacaccatctagtcttacgatcctcccgctaac

SEQ ID NO: 362405 - DNA, 728 bp, Homo sapiens
  misc_feature: GZ8MTXP02GQQXO.52.65.F10.1.454.CMB.2.raw
  modified_base (320)..(320): a, c, t, g, unknown or other
tcagcgcagtacgacacgaccggtgctcgatttagctacgctctaaggggggagtcagacccagtcaggacacagcatggacatgagggtccccgctcagctcctggggctcctgctgctctggttcccaggtgccaggtgcgacatccagatgacccagtctccatcttccgtgtctgcatctggtaggagacagacgtcaccatcacgttggtcggggacgtaggttcgtagggtttgttaggccgtaccgtggttacgcctgggttatcaagcaaacgaaaccgagggaaacgacccctaaagtcctggtactagtnctacactacctaatttgactaaaaggtcggtacccgtcccgtacgtaacggttacccgcgggactaaggtcggagttacggtacggggtaacttaaactttaccacgttcctaccacctaacgtccgacgacacgtacctacgacgagtaccgtagtaacgttagtttacgtacttaactttactacgttacgtaacgtaaacgggttacgggttaacgtttaccggtttaccgttaaccgtttaccgtttacgggaaccgggttaaacggggtaacgttaacggtacggtaacggtaaactaaacgttaaacgaaaacggtacgttacggtacggtacgtaaccgtacgtaaccgttaagttccgttacgttccttaccgtacgtttacccgtttacccgtactacg

SEQ ID NO: 362406 - DNA, 636 bp, Homo sapiens
  misc_feature: GZ8MTXP02JT1TT.52.65.F10.1.454.CMB.2.raw
  modified_base (133)..(133): a, c, t, g, unknown or other
  modified_base (310)..(310): a, c, t, g, unknown or other
  modified_base (602)..(602): a, c, t, g, unknown or other
tcagcgcagtacgacacgaccggtgctcgatttagctacgctctaagggggagtcagacccagtcaggacacagcatggacatgagggtccccgctcagctcctggggctcctgctgctctggttcccaggtnccaggtgcgacatccagatgacccagtctccatcttccgtgtctgcatctggaggagacagacgtccaccatcctacgttggtccggggcgagttcgtagggtttgttacggccgtccgttagggttagcccgtggtatcgagcaagaaacgacggaacaccctaagtcctgtctangactacatcctattcgactaaacggtgtacccgtacccgtagtaacggggttcccgcggtacgagggttcggtaacgttcgtaacggggtaactaaaactttcacttacccttacaccctatccgaacgcaacgtccctagcccgaacgtcccgtaggtaacgttagttttacgaccgtttaacttactagttcgtaaacgaaccggttagggtacttacgtttccgtactacggttacgccgtaagggtactagtcgagtacgatacgtaaacgatcgtagcctacgaccncgtaactctcgttactcgactcttaccgactacg

SEQ ID NO: 362407 - DNA, 305 bp, Homo sapiens
  misc_feature: GZ8MTXP01C3BER.25.57.F02.1.454.CMB.2.raw
  modified_base (301)..(305): a, c, t, g, unknown or other
tcagactgtacagtcacgaccggtgctcgatttagctcgatatagttgggtttgggggaagaggaagactgacggtcctcccaggagttcaggtgctgggcaccttgggcacggggaggtgtgtcacaagattgggctctgggcaccctggtcacggtctcgtcagcttccaccaagggcccatcggtcttccccctggcgccctgctccaggagcacctctgggggcacagcggccctgggctgcctggtcaaggactacttccactgtacagtctgagcgggctggcaaggcgcatagnnnnn

SEQ ID NO: 362408 - DNA, 304 bp, Homo sapiens
  misc_feature: GZ8MTXP01A4VZT.25.57.F02.1.454.CMB.2.raw
  modified_base (301)..(304): a, c, t, g, unknown or other
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcaccctggtcacggtctcgtcagcttccaccaagggcccatcggtcttcccctggcgccctgctccaggagcacctctgggggcacagcggccctgggctgcctggtcaaggactacttccactgtacagtctgagcggctggcaaggcgcatagnnnn

SEQ ID NO: 362409 - DNA, 306 bp, Homo sapiens
  misc_feature: GZ8MTXP01AM12X.25.57.F02.1.454.CMB.2.raw
  modified_base (287)..(287): a, c, t, g, unknown or other
  modified_base (302)..(306): a, c, t, g, unknown or other
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcaccctggtcacggtctcgtcagcttccaccaagggcccatcggtcttccccctggcgccctgctccaggagcacctctgggggcacagcggccctgggctgcctggtcaaggactacttccactgtacagtctgagcggcnggcaaggcgcatagnnnnn

SEQ ID NO: 362410 - DNA, 348 bp, Homo sapiens
  misc_feature: GZ8MTXP01ETU86.25.57.F02.1.454.CMB.2.raw
  modified_base (346)..(348): a, c, t, g, unknown or other
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatggggaggtgtgtcacaagatttgggctctgggcaccctggtcacggtctcgtcagcttccaccaagggcccatcggtcttccccctggcgccctgctccaggagcacctctgggggcacagcggccctgggctgcctggtcaaggactacttccactgtacagtctgagcggctggcaaggcgcatagnnn

SEQ ID NO: 362411 - DNA, 606 bp, Homo sapiens
  misc_feature: GZ8MTXP01EDP0V.25.57.F02.1.454.CMB.2.raw
  modified_base (315)..(315): a, c, t, g, unknown or other
  modified_base (401)..(401): a, c, t, g, unknown or other
  modified_base (475)..(475): a, c, t, g, unknown or other
  modified_base (537)..(537): a, c, t, g, unknown or other
tcagactgtacagtcacgaccggtgctcgatttagctcgatatagttgggtttggggagctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggagcgtggtccgaggccggggaagtccctgagactctcctgtgcagtcgtccgcgtccaccttcgtcgtttggctagttccacgtgggtcccnccgaggcctccgaggccgaaggggactgggaggtggggtggcggtcagtagtgggtcgggatggaagtaatgaacttattttaagngacagtaccgtccggtaggaacgggcccactcactatcaccgagacggcagcctacaaacgacttaccgtttancgtagacttaaagttacgaaaccgtgacgactacgacgtacgtcgtcttgtcttagttacgnggccggtcgggttacaggaacgacggcggggtcgggtcctacgtacgggctaacggttcgggaacccgg

SEQ ID NO: 362412 - DNA, 642 bp, Homo sapiens
  misc_feature: GZ8MTXP01DYVC3.25.57.F02.1.454.CMB.2.raw
  modified_base (214)..(214): a, c, t, g, unknown or other
  modified_base (461)..(461): a, c, t, g, unknown or other
  modified_base (477)..(477): a, c, t, g, unknown or other
  modified_base (490)..(490): a, c, t, g, unknown or other
  modified_base (496)..(496): a, c, t, g, unknown or other
  modified_base (522)..(522): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtctttgtctccgaggggaaangccaccctctcctgcagggccagtcagagtgtgagcagcaacttcttagtctaggtaaccaacataaagcaaggccaggcctcccagacctcactccgtaggtaccggggaccaaacccgaccgaaggggcccaaagggggccaactccccgaagaccgtacgggttccaggtcggggcggggttggggtaccgttaggggaaccgtaggacgtttccaacctcctacacccataccaaacaggacnggacgccgtagaagtnttttgctaggttnttattnttaggtacaggtctagtagtggtacncttccgaccttccggtaacctaccggtttcggaaccggtacggggaccgtacgggcgtagggtaacgaacgttacgaaaacggtaacgtggtcggacctgacctaacccgttaagttccg

SEQ ID NO: 362413 - DNA, 699 bp, Homo sapiens
  misc_feature: GZ8MTXP01BZZC0.25.57.F02.1.454.CMB.2.raw
  modified_base (215)..(215): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagtaaattattttgacgcagtctccaggccaccctgtcttgtctccgaggggaaancgccaccctctcctgcagggccagtcagagtgtgagcagctaacttctagtctaggtaaccaacataaacgcaaggccaggcctcccagacctcactccgtaggtaccgggacaacccgaccgacgggaccgaagggccacgtacccagaccgtacggttcagggtcgggcgggtgggtacgtaggggaacaggtacgttccaccttccacaacctataccaacgacgacgtaggaacgtccgtaaggtagttagtttcgagtagttagttatttacgttggggtacgtaggtacttaaggtacgttagggttccgtaccttacccgttaacccgttaccggttaacccgttaacccggttttcggggaacccgggttaaccggggttacccggacgggttacggttaacgggaacgttaacgttaaaccgttaaaacggtaaccgtggttaacgggcttacggaccgtaacccttgttttccg

SEQ ID NO: 362414 - DNA, 657 bp, Homo sapiens
  misc_feature: GZ8MTXP01AMGFI.25.57.F02.1.454.CMB.2.raw
  modified_base (214)..(214): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtctttgtctccgaggggaaancgccaccctctcctgcagggccagtcagagtgtggagcagctaaactttcttagtcgtacggtaacccaaataataaacgcaacgggccaggtacctccccgaagtacctcactccgtacggtacggggacaaaccccgacgacgggaccgaaggcactcccgagacgtacggttcaggtcgggcgggtgggtctaagggggctagggtacgtctacctctacaaccacgtactaaacgacgagtcgggaacgccgtaggaacgttatttagacgttagttagttagtttagttggggtactagtacgtagttacgtggtactcttacccgtacccttccttaccttaccggtttcgggaaccgtacgggggaccctggaccgttaggaacgttaacgcgaaaaccgtaacgtggtaacggctacgacctaacttaacgttcg

SEQ ID NO: 362415 - DNA, 412 bp, Homo sapiens
  misc_feature: GZ8MTXP02GGUXV.25.57.F02.1.454.CMB.2.raw
  modified_base (409)..(412): a, c, t, g, unknown or other
tcagactgtacagtcacgaccggtgctcgatttagctcgatatagttgggtttggggaggaatatcaagagacggacgtaaagaatttttggagagacagtccggggccggctcgccctctccagagagaactttaggaacaccgcagaactgactctgagtcccgtgaggcctgaagacacgggattttattactgcgcaaggggcggcgaacaattctaagtcgcgagagattcgacccctggggccgggcaccctggtcacggtctcgtcagcttccaccaaggcccatcggtcttccccctggcgccctgctccaggagcacctctgggggcacagcggccctgggctgcctggtcaaggctacttccactgtacagtctgagcgggctgggcaaggcgcatagnnnn

SEQ ID NO: 362416 - DNA, 531 bp, Homo sapiens
  misc_feature: GZ8MTXP02FX8BV.25.57.F02.1.454.CMB.2.raw
  modified_base (210)..(210): a, c, t, g, unknown or other
  modified_base (317)..(317): a, c, t, g, unknown or other
  modified_base (332)..(332): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctccagataccaccggagaaattatttgacgcagtctccaggcacctgtcttgtctccgaggggaaanagccacctctcctgcagggccagtcagagtgtgagcagcaacttcttagtctggtaccaacataaagcaggccaggcctcccagactcatcctggtacgggcaaccncagggccaagggcanccagacaggtcagtggcggtggctggggacagacgttcactctacaccatacaacagactggacgcctagaacgtatttgctagtgttattatgtacagctagtatggtagctacgtacctccgtactaccgtttggaccgacggggtaccaggtcgtaggagactacgaaaacgaacgtgtcggactgacaccattcg

SEQ ID NO: 362417 - DNA, 532 bp, Homo sapiens
  misc_feature: GZ8MTXP02JZY5N.25.57.F02.1.454.CMB.2.raw
  modified_base (213)..(213): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtctttgtctccaggggaaanagccaccctctcctgcagggccagtcagagtgtgagcagcaacttcttagtctggtaccaacataaagcaggccaggctcccagactcatcctgtacgggcaaccaccagggccaagggcatcccagacaggttcagtggcggtgggtctgggcagagttcactctcaccatcaacagactggagcctagaagtattttgctagtgtattattgtcagcagtagtggtagtctcaccttccgtactaccgtttggcccgtaggggaccacggtcgtaggacgacgtacgaaacgaacgtagtcggactcgacaccatcg

SEQ ID NO: 362418 - DNA, 302 bp, Homo sapiens
  misc_feature: GZ8MTXP02FL9SI.25.57.F02.1.454.CMB.2.raw
  modified_base (301)..(302): a, c, t, g, unknown or other
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcaccctggtcacggtctcgtcagcttccaccaagggcccatcggtcttcccctggcgccctgctccaggagcacctctgggggcacagcggccctgggctgcctggtcaaggactacttccatgtacagtctgagcgggctggcaaggcgcatagnn

SEQ ID NO: 362419 - DNA, 540 bp, Homo sapiens
  misc_feature: GZ8MTXP02FU3G3.25.57.F02.1.454.CMB.2.raw
  modified_base (212)..(212): a, c, t, g, unknown or other
  modified_base (360)..(360): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtcttgtctccaggggaaangccacctctcctgcagggccagtcagagtgtgagcagcaacttcttagtctggtaccaacataaagcaggccaggctccagactcatcctgtacgggcaaccacagggccaagggcatccagacaggtcagtggcgtgggctggggcngagttcactctacaccatacaacagactggagcctagaagtatttgctagtgtattattgtcagctagtatggtagctcgacctccgtactaccgtttcggaccggtacgggaccgacggtacgtaggacgtacgtaacgaaaacggtaacgtggacggtcgtacgaccacctacgttcg

SEQ ID NO: 362420 - DNA, 565 bp, Homo sapiens
  misc_feature: GZ8MTXP02F3H37.25.57.F02.1.454.CMB.2.raw
  modified_base (213)..(213): a, c, t, g, unknown or other
tcagactgtacagtcacgaccggtgctcgattagctcgatatagttggggtttggggagagctctggagaagagctgctcagttaggacccagagggaaccatggaaaccccagcgcagcttctcttcctcctgctactctggctcccagataccaccggagaaattattttgacgcagtctccaggcaccctgtcttgtctccaggggaaangccacctctcctgcagggccagtcagagtgtgagcagcaacttcttagtctggtaccaacataaagcaggccaggcctcccagactcatcctggtacgggacaaccgaccagggccaaggggcaactcccagacaggttcaggtggcggtgggtctgggcagagttcactctacaccatacaacagactggacgcctagaagtatttgctagtgttaatttattggtacagactaggtatacggtagctactaccgttccgtaactaccgtttcggaccgtagggggacccaggcgtaggacgtaactaccgaaaacggaacgttaggtcgacgtacgacctaccacttccg

SEQ ID NO: 362421 - DNA, 605 bp, Homo sapiens
  misc_feature: GZ8MTXP02J0K8F.25.57.F02.1.454.CMB.2.raw
  modified_base (213)..(213): a, c, t, g, unknown or other
  modified_base (445)..(445): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtcttgtctccgaggggaaanagccaccctctcctgcagggccagtcagagtgtgagcagctaacttctagtctggtaccaacataaagcaggccaggcctcccagactcatccgtggtacgggcaaccgaccgagggccaagggcactcccagactaggtcaggtcgggcggttggggtcgtggggacaggtacgttccgactccgtacaccctataccaaacgagacgtggacgccgtaggatatttacgntagttgttattacttgtcagctagtagtggtacgtcctacgtaccgttaccgtactaccgtttcggaccggtaacgggggtaccgacgggtacgtacgggtaacgtaaccgtaacgaaaaccggtaacgtggtacggtcgtacgacctaaccgtattccg

SEQ ID NO: 362422 - DNA, 530 bp, Homo sapiens
  misc_feature: GZ8MTXP02FKJVC.25.57.F02.1.454.CMB.2.raw
  modified_base (213)..(213): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctccaggcaccctgtctttgtctccaggggaaanagccaccctctcctgcagggccagtcagagtgtgagcagcaacttcttagtctggtaccaacataaagcaggccaggctcccagactcatcctgtacgggcaaccacagggccaaggggcactcccagacacggttcagtggcggtgggtctggggacagagttcactctcaccatcaacagactggagcctagaagtatttgctagtgtattattgtcagctagtatggtagctcacctccgtactacgttcggaccgtaggggacccaggcgtaggacgaacgtacaaaacgaacgtgtacggctgaccacatcg

SEQ ID NO: 362423 - DNA, 744 bp, Homo sapiens
  misc_feature: GZ8MTXP02F0Z3J.25.57.F02.1.454.CMB.2.raw
  modified_base (210)..(210): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctcctgctactctggctcccagataccaccggagaaattattttgacgcagtctcaggcacctgtcttgtctccgaggggaanacgccaccctctcctgcagggccagtcagagtgtgagcagctaacttcttagtctaggtaaccaaacataaagcacggccaggcctacccgagacctcacttcccgtaggtaccggggaccaacccgaccgacgggacccaaagggccaactccccgaagaccgtacggttccaggtcgggcgggtggggtctaggggactaggcgttcaccttcgtccaaaccataccaaacgtacggtacgtagggaacgtcctaaggtaacgtttacgttttacgacgttaaggtttgtttaaagttttagttacggttaccgtaaggtacgtaaaggtttaggttacgggttaaccggtaccttaccccgtaccccgttacccggttaacccgttacccgggttttacggggacccggtaacgggggtaaccgtaaccggggtacggtacggggtaacgtaaccgtaaacccggtaaaaccggtaacggttaacgggtcggtaccgttaccggacccgtaaccgtttaaccgtttaccgg

SEQ ID NO: 362424 - DNA, 546 bp, Homo sapiens
  misc_feature: GZ8MTXP02H359P.25.57.F02.1.454.CMB.2.raw
  modified_base (209)..(209): a, c, t, g, unknown or other
  modified_base (340)..(340): a, c, t, g, unknown or other
  modified_base (365)..(365): a, c, t, g, unknown or other
  modified_base (382)..(382): a, c, t, g, unknown or other
tcagactgtacagtcacgaccggtgctcgattagctcgatatagttgggtttggggagagctctggagaagagctgctcagttaggacccagagggaaccatggaaaccccagcgcagcttctcttcctctgctactctggctccagataccaccggagaaattatttgacgcagtctccaggcaccctgtctttgtctccaggggaangccacctctcctgcagggccagtcagagtgtgagcagcaacttcttagtctggtaccaacataaagcaggccaggcctcccagctcatcctggtacgggcaaccgacgagggccaagggcactcccagacnggtcagtggcggtggtctgggcagngttcactctcacatcanagctggacgcgtagaacgtatttgctagtgtagttattgtactagctagtagtcggtagctcaccttccggtacctaccgtttcggaccgtacggggacctacggcgttacgggagacgtaaccgaaacgtaacgtcgtacggcttcggacctacgtaacttcg

SEQ ID NO: 362425 - DNA, 561 bp, Homo sapiens
  misc_feature: GZ8MTXP01D9VXD.15.34.D01.1.454.CMB.2.raw
  modified_base (261)..(261): a, c, t, g, unknown or other
  modified_base (266)..(266): a, c, t, g, unknown or other
  modified_base (268)..(268): a, c, t, g, unknown or other
  modified_base (271)..(271): a, c, t, g, unknown or other
  modified_base (292)..(292): a, c, t, g, unknown or other
  modified_base (301)..(301): a, c, t, g, unknown or other
  modified_base (303)..(303): a, c, t, g, unknown or other
  modified_base (308)..(308): a, c, t, g, unknown or other
  modified_base (320)..(320): a, c, t, g, unknown or other
  modified_base (341)..(341): a, c, t, g, unknown or other
  modified_base (345)..(345): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagcgtggtttcgtgtagctatttagaaggtgtccaggtgaggtgcaggtggtggaatcgtgggggaggcttgggtccagcctggggggtccctgagactctcctgtgcagcctngatcntntanaatatgatagtggtcgcagcncgaggaggngnggagngagtgacaatanagaacaagagaagagataaanatanagtagtggcgtgtgtgcgacgggacgtatactactatctacagagaacaacgacaaagaatactagtagttattagtaacgaaataagaacgacgacgtagagacgaccgacgacgacgtcgtgtgttagttagtgttggcggggacggggcgggttggttaggttaagtttaggtaagttacgttcggttacgggtccgggaacgggtaacccgg

SEQ ID NO: 362426 - DNA, 522 bp, Homo sapiens
  misc_feature: GZ8MTXP01CLQU8.15.34.D01.1.454.CMB.2.raw
  modified_base (492)..(492): a, c, t, g, unknown or other
  modified_base (514)..(514): a, c, t, g, unknown or other
tcagtctacgtagccacgaccggtgctcgatttagatcgtctgtgttgggttgggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatccgcttctctgctccatcctgggaacaaagctgccctcaccatcacgggggcccaggcagacgatgaatgtgattatcacgtgcgttcctttatggtggggcgtggctagtttggggtgttcgggcggaagggaccaaacgtgaccgtcctaggttcngcccaaggctgcccctggttcncttctccg

SEQ ID NO: 362427 - DNA, 574 bp, Homo sapiens
  misc_feature: GZ8MTXP01DVFV9.15.34.D01.1.454.CMB.2.raw
  modified_base (424)..(424): a, c, t, g, unknown or other
  modified_base (430)..(430): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatcacagtacaaacactcgctcgttccggggtccctgactcccgcttctctcgcctccatcccgtagggaaacaaagctcgcccctcaccatcgacggggcccaggcagacgatagatgngattancacgtgtcgttccttagtggtggggcgtggtcgtagtttggggtggttcgggcgggtaacgggaaccaaacgtcgaccgtccgttaggccgacggaccccgtaaggcctccggcccccgtcggttcctaaccttcgtttccccg

SEQ ID NO: 362428 - DNA, 523 bp, Homo sapiens
  misc_feature: GZ8MTXP01DSYWH.15.34.D01.1.454.CMB.2.raw
  modified_base (348)..(348): a, c, t, g, unknown or other
  modified_base (382)..(382): a, c, t, g, unknown or other
  modified_base (415)..(415): a, c, t, g, unknown or other
  modified_base (421)..(421): a, c, t, g, unknown or other
  modified_base (456)..(456): a, c, t, g, unknown or other
  modified_base (488)..(488): a, c, t, g, unknown or other
tcagtctacgtagccacgaccggtgctcgatttagatcgtctgtgttgggtttggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacactcgctcttccggggccctgactccgcttcnctgcctccatcccttgggaaacaaagctgccctnaccatcgacggggcccaggcagacgatgaatgngattancactgcgtcttatgtgggctgctgttggtgtcggnggaagggaccaaacgtcgacgtcctaggttcncgcccaaggctcgcccctcggttcaacttcgtccg

SEQ ID NO: 362429 - DNA, 527 bp, Homo sapiens
  misc_feature: GZ8MTXP01AMWLL.15.34.D01.1.454.CMB.2.raw
  modified_base (518)..(518): a, c, t, g, unknown or other
tcagtctacgtagccacgaccggtgctcgatttagatcgtctgtgttggggttgggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctggctccatcctgggaacaaagctgccctcaccatcacgggggcccaggcagacgatgaatgtgattatcactgcgttcctttagtggtggggcgtggctagtttgggtgttcgggcggaagggaccaaacgtcgaccgtcctaggttcagcccaaggctcgcccctcggttcncgttctccg

SEQ ID NO: 362430 - DNA, 566 bp, Homo sapiens
  misc_feature: GZ8MTXP01B6UQ9.15.34.D01.1.454.CMB.2.raw
  modified_base (420)..(420): a, c, t, g, unknown or other
  modified_base (523)..(523): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttcaactaccgccgcctggtaccggcacgaccccaggccagccctccacgcacgctcatctacagtacaaacactcgctcgttccgggtccctgactccgcttctctgcctccatccttagggaaacaaagctcgccctcacccatcgacgggggcccaggcacgacgatgaatggntatatcactgtcgttcctttagtggtggggtcgtaggtccgtagtttggggtggtttcgggcgggaacggggaaccaaacgtcgaccgtcccgtagggttccncggcccaaggcctcgccccctgggttcctaacgttccttcccg

SEQ ID NO: 362431 - DNA, 548 bp, Homo sapiens
  misc_feature: GZ8MTXP01C0JPM.15.34.D01.1.454.CMB.2.raw
tcagtctacgtagccacgaccggtgctcgatttagatcgtctgtgttgggtttggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactccgcttctctggctccatccttgggaaacaaagctgccctcaccatcgacggggcccaggcagacgatgaatgtgattatcactgcgttcctttagtgtggggcgtggactagtttggggtcttcgggcggaagggacccaaacgtgaacccgttcctaaggttcgacgccccaaggcctcgccccctcggttctaaccgttcttcccg

SEQ ID NO: 362432 - DNA, 561 bp, Homo sapiens
  misc_feature: GZ8MTXP01BJFQQ.15.34.D01.1.454.CMB.2.raw
tcagtctacgtagccacgaccggtgctcgatttagatcgtctgtgttggggttgggaagcctgagaacacttagccttcatgagtgtcccaccatggcctggatgatgcttctcctcggactccttgcttatggatcaggagtggattctcagactgtggtgacccaggagccatcgttctcagtcgtcccctggagggacagtcacactcacttgtgccttgagtctggctcagtctctacttctaactacgccgctggtaccgcacgacccaggccacgcctccacgcacgctcatctacagtacaaacactcgctccgttccgggtcctgactccgcttctcgtcgcctccatccgttagggaaacaaagctacgccctcaccatcgacggggccaggcagacgatgaatgtagtattatccacgtcgtccgttacctttagtgggtggggcgtggtacgtagtttggggtgttcggggcggaagggaaccaaagtcgaccgtccgtacggttcgcgcccgaaggctccgcccccgtcggttcctccttccgttcccg

SEQ ID NO: 362433 - DNA, 556 bp, Homo sapiens
  misc_feature: GZ8MTXP01D9OM9.15.34.D01.1.454.CMB.2.raw
  modified_base (316)..(316): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacnctcgctcttccgggtcctgactccgcttctctgctccatccgtagggaaacaaagctcgccctcaccatcgacggggcccagggcagacgatgaatgtagattatcacgtcgtcgttcctttagtggtggggcgtggcgtagtttggggtgttcgggcgggaagggaccaaacgtcgacccgtccgtaggttcgcgaccccgaagggcctccgcccccgtcggcctaaccgttcttcccg

SEQ ID NO: 362434 - DNA, 567 bp, Homo sapiens
  misc_feature: GZ8MTXP01DQ80U.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctaacagtacaaacactcgctcgttccggggtccctgactccgcttctctgctccatccgtgggaaacaaagctgccctcaccatcgacggggccaggcagacgatgaatgtgattatcacgtcgccggttcctttagtggtggggcgtgggtctagtttggggtggttcgggcgggaacgggaaccgaaacgtcggaaccgtcctagggttcgacggccccgaagggcctcggccccctcggcctaaccgttccgttccccg

SEQ ID NO: 362435 - DNA, 552 bp, Homo sapiens
  misc_feature: GZ8MTXP01DVOEM.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggtcctgactccgcttctctggctcccatccgttgggaaacaaagctcgccctcaccatcgacggggcccaggcagacgatagaatgtgattatcacgtgtcgttcctttagtgtggggcgtggctagtttggggtgttcgggcgggaagggaccaaacgtcgttaaccgtccgtagggttcacgcccgaacgggctcgccccctcggttctccgttcgttcccg

SEQ ID NO: 362436 - DNA, 542 bp, Homo sapiens
  misc_feature: GZ8MTXP01CVND3.15.34.D01.1.454.CMB.2.raw
  modified_base (531)..(531): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggccctgactccgcttctctgctccatccttgggaacaaagctgccctcaccatcacggggcccaggccagacgatgaatgtgattatcacgtgcgttcctttagtggtggggcgtggtcgagtttggggtgttcgggcgggaaggggaaccaaacgtcgaccgtccgtggttcgacgcccaaggcctcgcccctcggttcncgttcgttccg

SEQ ID NO: 362437 - DNA, 553 bp, Homo sapiens
  misc_feature: GZ8MTXP01DPK4X.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgagtctggctcagtctctacttctaactacgccgctggtaccggcacgaccccaggccacgcctccacgcacgctcatctacagtacaaacactcgctcgttccggggtccctgattcccgcttctctggcctccatcccgttagggaaacaaagctacgcccctacaccatcgacgggggcccaggccagacgatgaatgtagattatcacgtgtccggttcctttagtggtggggcgtggtactgtttgggtgttcgggcgggaacgggtaccaaagtcgaccgtctagggttcagcccaaggctcgcccctcggctcgttcgtcccg

SEQ ID NO: 362438 - DNA, 554 bp, Homo sapiens
  misc_feature: GZ8MTXP01B87KG.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgttccgggtccctgactccgcttctctgctccatcctgggaacaagctcgccctcaccatcgacgggggcccaggcagacgatgaatgtgattatcacgtgtcgttcctttagtggtggggcgtggcgtagtttggggtcgttcgggcggaacggggaaccaaacgtcgaccgtccgtaggttaccgcggacccaaggcctccgccccgtcggttcctaaccttcgttcccg

SEQ ID NO: 362439 - DNA, 562 bp, Homo sapiens
  misc_feature: GZ8MTXP01CTHV9.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgctggtaccgcacgaccccaggccacgcctccacgcacgctcatctacagtacaacactcgctcgtccgggtcctgactccgtcttctctgcctaccatccgttagggaaacaaacgctcgccctacacccagtccgacggggcccaggcagacgatgaatgtagtattatctacgttcgtcgttacctttagcggtggggcgtggtcgtagtttggggtgtcgggcggaacgggaacaacgtcgaccgtcgtacgttcgcgacccgaaggcctccgcccctcggttctccgttcgttcccg

SEQ ID NO: 362440 - DNA, 560 bp, Homo sapiens
  misc_feature: GZ8MTXP01AZNWP.15.34.D01.1.454.CMB.2.raw
  modified_base (426)..(426): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctccgttccgggtccctgactccgcttctctcgctccatcctagggaaacaaagctcgccctcacccatccgaccggggcccaggccagacgatagatggtntattatcacgtcgtcgttccttagtggtgggtcgtggtctagtttgggtgttcgggcgggtaacgggaaccaacgtcgaccgtcgtaggttcgcgccgaaggccgtcgccccgtcggttcctcttccgttcccg

SEQ ID NO: 362441 - DNA, 548 bp, Homo sapiens
  misc_feature: GZ8MTXP01DXVM3.15.34.D01.1.454.CMB.2.raw
  modified_base (427)..(427): a, c, t, g, unknown or other
  modified_base (500)..(500): a, c, t, g, unknown or other
  modified_base (526)..(526): a, c, t, g, unknown or other
tcagtctacgtagccacgaccggtgctcgatttagatcgtctgtgttgggtttgggctcagagaggagccttagccctggactccaaggcctttccacttggtgatcagcactgagcacagaggactcaccatggaattggggctgagctgggttttccttgttgctatttagaaggtgtccagggtgaggtgcaggtggtggaatcgtgggggaggcttggtccagccgtgggggtccctgagactctcctgtgcagcctctggattcagttctagtaaatactggataagttgggtccgccaggctccgaggggaaggggctggagtggatggccaatatgaaccaagacggaagtgataaacatcatgtgggctctgtgcgagggccgattcactatctcagagacaacgcaaagaatctagtntatttgacaaatgaaacagcctgagagaccgacgacacgggctgtgtattacgtggttgcggggagggccggngttgggtaatttgggaattcgttcgngggggtccgaagggggtccccg

SEQ ID NO: 362442 - DNA, 540 bp, Homo sapiens
  misc_feature: GZ8MTXP01DW1WZ.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcagaccccaggccagcctccacgcacgctcatctacagtacaaacactcgctcttccgggtcctgactccgcttctctgctccatccgtagggaacaaagctcgccctcaccatcgacggggcccaggcagacgatgaatgtgattatcacgtgtcgttcctttagtggtggggcgtggctagtttggggtgttcgggcggtaacggaccaaacgtcgaccgtcgtaggttcgcgcccaaggcctcgcccctcggttacctcgttcgttcccg

SEQ ID NO: 362443 - DNA, 530 bp, Homo sapiens
  misc_feature: GZ8MTXP01ATEP5.15.34.D01.1.454.CMB.2.raw
  modified_base (376)..(376): a, c, t, g, unknown or other
  modified_base (520)..(520): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatccgcttctctgctccatccttgggaacaaagctgccctnaccatcgacggggcccaggcagacgatgaatgtgattatcacgtgtcgtcctttatggtggggcgtggactgttggggtgttcggcggaagggaccaaactcgaccgtctaggttcgagcccgaaggctcgccccctggttacncgttctcccg

SEQ ID NO: 362444 - DNA, 547 bp, Homo sapiens
  misc_feature: GZ8MTXP01D2R4W.15.34.D01.1.454.CMB.2.raw
  modified_base (508)..(508): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccgcagaccccaggccagccctccacgcacgctcatctacagtacaaacactcgctcttccgggtcctgactccgcttctctcggctcccatcccgttagggaaacaaagctcgccctcaccatcgacggggccaggcagacgatgaatgtgattatcacgtcgcgtttcctttagtggtggggtcgtggctagtttggggtgttcgggcgggaacggaccaaagtcgaccgtcgtaggttcncgcccgaagcctcgcccctcggttctaacgttcgttccg

SEQ ID NO: 362445 - DNA, 548 bp, Homo sapiens
  misc_feature: GZ8MTXP01BQWCW.15.34.D01.1.454.CMB.2.raw
  modified_base (320)..(320): a, c, t, g, unknown or other
  modified_base (474)..(474): a, c, t, g, unknown or other
  modified_base (510)..(510): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgctggtacccggcacgaccccaggccagccctccacgcacgctcatctacagtacaaacnctcgctcgttccgggtcctgatccgcttctctgctccatccgttagggaaacaaagctcgccctcaccatcgacggggccaggcagacgatgaatgtgattatcacgtgtcgttcctttagtggtggggcgtggcgtgtttggggtgttcgggngggaacgggaacaaacgtcgaccgtcgtaggttcgngcccgaaggcctcgccccgtggttcctcgttcgtcccg

SEQ ID NO: 362446 - DNA, 537 bp, Homo sapiens
  misc_feature: GZ8MTXP01EC3MW.15.34.D01.1.454.CMB.2.raw
  modified_base (510)..(510): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccacgcctccacgcacgctcatctacagtacaaacactcgctcttccggggtccctgactccgcttctctcggctcccatcccgttgggaaacaaagctacgcccctcaccatccgacggggcccaggcagacgatgaatgtcgaattatcacgtgtcgttcctttagtggtggggcgtggtctagtttgggtgttcgggcggaaggaccaaagtcgaccgtctagttcgngcccaagctcgccctgctcttcgtccg

SEQ ID NO: 362447 - DNA, 558 bp, Homo sapiens
  misc_feature: GZ8MTXP01D0MRJ.15.34.D01.1.454.CMB.2.raw
  modified_base (485)..(485): a, c, t, g, unknown or other
  modified_base (519)..(519): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactaccgccgcctggtaccggcacgaccccaggccagccctccacgcacgctcatctacagtacaaacactcgctcgttccgggtccctgactccgcttctcgtcgcctccattcccgtagggaaaccaaagcctcgcccctcacccatcgaccggggcccaggcagacgatagaatgtagattatcacgtgtcgttcctttagtggtgggcgtggctagtttgggtgttcggngggaaggacccaaagtcgaccgtccgtaggttcncggacccaaggctccgcccctcggctaaccttcgtcccg

SEQ ID NO: 362448 - DNA, 532 bp, Homo sapiens
  misc_feature: GZ8MTXP01C2VXY.15.34.D01.1.454.CMB.2.raw
  modified_base (381)..(381): a, c, t, g, unknown or other
  modified_base (501)..(501): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacactcgctcgttccggggtccctgactccgcttctctggctccatccttagggaacaaagctgccctnaccatcgacggggcccagggcagacgatgaatgtgattatcacgttgcgttcctttagtggtggggcgtggctagtttgggtgttcgggcggaagggacaaacgtgaccgtcgtggttcngcccaagctcgcccctggttctcgttctccg

SEQ ID NO: 362449 - DNA, 539 bp, Homo sapiens
  misc_feature: GZ8MTXP01AES9E.15.34.D01.1.454.CMB.2.raw
  modified_base (529)..(529): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactccgcttctctggctccatcccttgggaacaaagctgccctcaccatcgacggggcccaggccagacgatgaatgtgattatcacgtgcgttcctttagtgtgggggcgtggctagtttggggtgttcgggcggaagggaccaaacgtcgaccgtctaggttcgcgcccaaggctcgcccctggttccncttcgtcccg

SEQ ID NO: 362450 - DNA, 574 bp, Homo sapiens
  misc_feature: GZ8MTXP01B2SEO.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgccctccacgcacgctcatctacagtacaaacactcgctcgttccggggtcctgactccgcttctctcggctaccattcccgttagggaaaccaaagcctcgcccctcacccatcgaccggggccaggcagacgatagaagtgtgattatcacgtcgtcgttcctttagtggtggggtcgtggtcgtaggtttggggtcggttcgggcgggtaacgggaaccaaacgtcggaccgttccgtacggttcgcggacccgaaggcctccgcccctcggcctccttcgttcccg

SEQ ID NO: 362451 - DNA, 549 bp, Homo sapiens
  misc_feature: GZ8MTXP01DETVY.15.34.D01.1.454.CMB.2.raw
  modified_base (473)..(473): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcgttccgggtcctgactccgcttctctgctcccatccttagggaacaaagctcgccctcaccatcgacggggcccaggcagacgatgaatgtgattatcacgtgtcgttccgtttagtggtggggtcgttggctgtttgggtgttcgggnggaagggaccaaacgtcgaccgtcgtaggttcgcgcccgaaggcctcgccccctcggttcctaacgttcgttcccg

SEQ ID NO: 362452 - DNA, 598 bp, Homo sapiens
  misc_feature: GZ8MTXP01BJL4P.15.34.D01.1.454.CMB.2.raw
  modified_base (335)..(335): a, c, t, g, unknown or other
tcagtctacgtagccacgaccggtgctcgatttagatcgtctgtgttgggtttgggggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcagaccccaggccagcctccacgcacgctcatctacagtacaaacactcgctcttccgggggtcccngtacgtcctctctcgtcgtcctactaccttcggtaacgaaacgaactcgtcccgtccaccactacgacgggacccgggacgacgacgaacgacgtagataagtgtatatactactacggtcggtccctttattcgttggggtcggtcggtcgtagtttggtttgggttccggtcgggcgggaacgaaccgttaacgtacgttaccgtacggtattacgcgacccgaacgccgtcgtccccgtcccgttcgtccttccttcccg

SEQ ID NO: 362453 - DNA, 596 bp, Homo sapiens
  misc_feature: GZ8MTXP01C6PRE.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagccctccacgcacgctcatctacagtacaaacactcgctcgttccgggtccctgactcccgcttctcgtggcctcccattcccgttaggggaaaccaaagcctcgcccctcacccatcgaccgggggcccagggcaggacgatagaatgtagattactcacgtcgtcgtttcctttagtgggtcggggcgttggtctaggtttgggtggttcgggcgggtaacgggaaccaaacgtcggaccgttccgtagggttccgcgacccgaagggcctccgcccccgtcggttcctaaccgttccgttccccgg

SEQ ID NO: 362454 - DNA, 548 bp, Homo sapiens
  misc_feature: GZ8MTXP01AMC3D.15.34.D01.1.454.CMB.2.raw
  modified_base (470)..(470): a, c, t, g, unknown or other
  modified_base (509)..(509): a, c, t, g, unknown or other
  modified_base (539)..(539): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactccgcttctctggctccatccttgggaaacaaagctgccctcaccatcgacggggcccaggcagacgatgaatgtagattatcactgcgttcctttagtcgtggggcgtggctagtttggggtgttcgggngggaacgggaccaaacgtcggaaccgtctaacgggttcncggcccaagggcctcgccccgtcggttccncttcgtccg

SEQ ID NO: 362455 - DNA, 564 bp, Homo sapiens
  misc_feature: GZ8MTXP01CXW3J.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacactcgctcgttccgggtccctgactccgcttctctcggctaccactccgttagggaaacaaacgctcgccctcaccatcgacggggcccaggcagacgatgaatgtagattatctactcgtccgttcctttagtggtgggggtcgtggtctagtttggggtcgttcgggcgggaacgggaccaaacgtcgaaccgtccgtaggttcgcgcccgaaggctccgcccctcggttcctaaccttcgtcccg

SEQ ID NO: 362456 - DNA, 569 bp, Homo sapiens
  misc_feature: GZ8MTXP01EWU80.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagccctccacgcacgctcatctacagtacaaacactcgctcgttccggggtccctgactccgcttctctggctccatcccttagggaaacaaagctcgcccctcaccatcgacggggcccaggcagacgatgaatgtgattatcacgtgtcgttcctttagtggtggggtcggtggtcgtagtttggggtggttcgggcgggtaacgggaaccaaacgtcggacccgtccgtaggttccgcgcccgaaggcctccggccccctcggttcctaaccgttccttcccg

SEQ ID NO: 362457 - DNA, 571 bp, Homo sapiens
  misc_feature: GZ8MTXP01AV98E.15.34.D01.1.454.CMB.2.raw
  modified_base (498)..(498): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtggggggtccctgagactctcctgtgcagcctctggattcagttctagtaaatactggataagttgggtccgccaggctccgaggggaaggggctggagtggatggaccaatatgaaaccaaggacggaagtgaataaacatcatgtgggctcgtgtgcaggggccgattcactatctccagagacaacgccaaagaatctagtgtatttgactaaatgaaacacgcctgacgagaccgacgaccacgggctggtaagtattacgnggttggccggggtaagggccggttgttggttaagtttgggaacttcggtttcgcggggccgaacgggggtccc

SEQ ID NO: 362458 - DNA, 620 bp, Homo sapiens
  misc_feature: GZ8MTXP01CEXHV.15.34.D01.1.454.CMB.2.raw
  modified_base (316)..(316): a, c, t, g, unknown or other
  modified_base (599)..(599): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccgcacgaccccaggccacgcctccacgccacgctcactctacagtacaaacnctcgctcgttcccgggcctgactccgtcttctctggcctaacacttcccgttagggaaaccaaagtcctacgcccctacaacccatcccgaccgggggccccaaggcaaggtacgagttagaaagtgtagtaattactacctacggtcgtccggtttacctttagtcgggggttggggcccggttggtaccgttgggttttcggggtcggttcggggacggaacggggtaacccaaacgttcggaccgtcgtaagccgacgcccgaaggcctccggtccccgnggttcctaacttccgttcccg

SEQ ID NO: 362459 - DNA, 559 bp, Homo sapiens
  misc_feature: GZ8MTXP01EKE1D.15.34.D01.1.454.CMB.2.raw
  modified_base (376)..(376): a, c, t, g, unknown or other
  modified_base (392)..(392): a, c, t, g, unknown or other
  modified_base (437)..(437): a, c, t, g, unknown or other
  modified_base (442)..(442): a, c, t, g, unknown or other
  modified_base (461)..(461): a, c, t, g, unknown or other
  modified_base (465)..(465): a, c, t, g, unknown or other
  modified_base (482)..(482): a, c, t, g, unknown or other
  modified_base (486)..(486): a, c, t, g, unknown or other
  modified_base (493)..(493): a, c, t, g, unknown or other
  modified_base (496)..(496): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggtttcctgttgctatttagaggtgtccagggtgaggtgcaggtggtggaatcgtgggggaggcttggtccagccgtggggggtccctgagactctcctgtgcagcctctggattcagttctaagtaaatactggataaggttgggtcccgccaggctccgaggggaagggctgggagtggatggaccaaatagtagaaaccaaggacggaagtagaataaacntcatggtgggctgtgngcgaggggccattccactatcctacagagaacaacgacaagactntagtntattgacaaatgaacagcngagngaccgacgtacacggtntgtntagttgnggnggcgggagggcggttggttggttgttggaacttcgttcggcggggtccgttaacggggtcccg

SEQ ID NO: 362460 - DNA, 613 bp, Homo sapiens
  misc_feature: GZ8MTXP01CW0ZE.15.34.D01.1.454.CMB.2.raw
  modified_base (320)..(320): a, c, t, g, unknown or other
  modified_base (438)..(438): a, c, t, g, unknown or other
  modified_base (458)..(458): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagccctccacgcacgctcatctacagtacaaacnctcgctcgttccgggccctgactccgcttctctgcctccatccgtagggaaacaacgctcgccctacaccacgtccggaccggggcccaggaccagaacgatagaatgtagtattacnctacgtcgtcgttccttagngggtcgggcgtggtcgttaggtttcggggtcggttcgggcgggtaaacgggtaacccttaaacgtccggaacccgttccgtaacggttccgaccggaccccgaaggtcccgtccccggtcccccgtcggttaccctaaccgttccgtttcccccg

SEQ ID NO: 362461 - DNA, 565 bp, Homo sapiens
  misc_feature: GZ8MTXP01EPYEM.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagccctccacgcacgctcatctacagtacaaacactcgctcgttccgggtcctgactccgcttctctgcctccattccgtagggaaacaaagctcgccctcaccatcgacggggcccaggcagtacgatgaatgtgattatcacgtcgtcgttcctttagtggtggggcgtggcgtaggtttggggtgttcggggcgggaacgggaaccttaaacgtcgaaccgtcgtaaggttcgacgcccgaaggcctccgtccccgtcggttcctaacgttccgttccccg

SEQ ID NO: 362462 - DNA, 580 bp, Homo sapiens
  misc_feature: GZ8MTXP01CP9VQ.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgatcccgcttctctcggcctccactcccgttagggaaaccaaagcctcgcccctcacccactcgacggggcccaggcagacgatgaatgtgattatcacgtgtcgttcctttagtggtgggcgtggcgttagtttgggtgttcgggcggaacggtaccgaaacgtcgacccgttacgtcggttccgcgaccccgaacggccgtccgccccgttcggttcctaacccgttcgtttccccgg

SEQ ID NO: 362463 - DNA, 617 bp, Homo sapiens
  misc_feature: GZ8MTXP01B8ZSK.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacactcgctcgttcccggggtccctgactcccgccttctctcggcctccactcccgttagggaaacaaagctacgcccctcacccatccgacgggggcccaggcagacgatgaatgtgattatcacgtcgtcgttcctttagtggtggggtcgtggtccgttagtttggggtcgttcgggcgggtaacgggaacccgttaaacgttcggaacccgttccgtacgggttccgacggttacccccgaaagggtcccgtcccggccccccgttccgggttaccctaacccgttccgtttaacccccg

SEQ ID NO: 362464 - DNA, 578 bp, Homo sapiens
  misc_feature: GZ8MTXP01D4DRN.15.34.D01.1.454.CMB.2.raw
  modified_base (420)..(420): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttcgtgccttgaggtctggctcagtctcctacttctaactacgccgcctcgtaccggcacgaccccaggccagccctccacgcacgctcactctacagtacaaacactcgctcgttccgggtccctgactccgcttctcgtggcctcccattccgttagggaaacaacgctcgccctcaccactcgacggggcccaggcacgagatnaatgtgattatcacgttgtcgtccgtttagtcgtggggtcgttgggtcgtagtttgggtggttcgggtcgggtaacgggaccgaaacgtcgaccgtccgtacggttccgacgcccgaacggccgtccgcccccgtccggttcctaaccgttccgtccg

SEQ ID NO: 362465 - DNA, 601 bp, Homo sapiens
  misc_feature: GZ8MTXP01EVI4S.15.34.D01.1.454.CMB.2.raw
  modified_base (321)..(321): a, c, t, g, unknown or other
  modified_base (475)..(475): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtccccgtggagggacagtcacactcacttgtgccttgaggtctggctcagtctctacttctaactacgccgcctcggtaccgcacgaccccaggcccagccctccacgcacgctcatctacagtacaacnctcgtctcgttccgggtcctgactccgcttctctgcctaccattccgtagggaaacaaagctcgccctcaccatccgacggggccaggcagacgatagaactgtagtattacactacgtcgtccgtttacctttagtgggtcggggcgttcggnttagggtttggggtcgttccggggacggaaggggtaaacccaaacggtcggacccggtcgtaacggttccgacggacccgtaacggccctccgtcccccgtggttccctaaccgttccgttccccg

SEQ ID NO: 362466 - DNA, 547 bp, Homo sapiens
  misc_feature: GZ8MTXP01DSOC1.15.34.D01.1.454.CMB.2.raw
  modified_base (348)..(348): a, c, t, g, unknown or other
  modified_base (382)..(382): a, c, t, g, unknown or other
  modified_base (472)..(472): a, c, t, g, unknown or other
  modified_base (507)..(507): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgactccgcttcnctggctcccatccttgggaaacaaagctgccctnaccatcgacggggcccaggcagacgatgaatgtgattatcaacgtgcgttcctttagtggtggggcgtggctagtttggggtgttcgggnggtaagggaccaaacgtcgaccgtccgtaggttcngcccaagggcctcggcccctcggttcctcgttcgttcccg

SEQ ID NO: 362467 - DNA, 547 bp, Homo sapiens
  misc_feature: GZ8MTXP01B1O9D.15.34.D01.1.454.CMB.2.raw
  modified_base (418)..(418): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgttccgggtcctgactccgcttctctggctccatcccgtagggaaacaaagctcgcccctcaccatcgacggggcccaggcagacgatgaatgngattatcacgtgtcgttcctttagtggtggggcgtggcgtagtttgggtgttcgggcggaagggaccaaacgtcgaccgtcgtaggttcgcgcccgaaggcctcgccccgtcggttcctcgttcgtccg

SEQ ID NO: 362468 - DNA, 559 bp, Homo sapiens
  misc_feature: GZ8MTXP01AV6W8.15.34.D01.1.454.CMB.2.raw
  modified_base (547)..(547): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgactccgcttctctcggctccatccttgggaaacaaagctcgccctcaccatcgacggggccaggcagacgatgaatgtgattaatcacgtgtcgttcctttagtggtggggcgtggtcgtagtttggggtggttcgggcgggaagggaaccaaacgtcggaccgtccgtaggttcgacgcccgaaggcctcggccccctcggttccncgttcgttcccg

SEQ ID NO: 362469 - DNA, 531 bp, Homo sapiens
  misc_feature: GZ8MTXP01ER1GS.15.34.D01.1.454.CMB.2.raw
  modified_base (526)..(526): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtagcggcagaccccaggccagcctccacgcacgctcatctacagtacaaacactcgctcttccggggtccctgactcgcttctctggctccaatccttagggaaacaaagctcgccctcaccatcgacgggggcccaggcagacgatgaatgtgattatcgactgcgttctttagtgtggggcgtggctagtttgggtgttcgggcgggtaggaccaaacgttcgaccgtcttaggttcagcccaaggctcgccccttcggtcncgtcc

SEQ ID NO: 362470 - DNA, 549 bp, Homo sapiens
  misc_feature: GZ8MTXP01BADIP.15.34.D01.1.454.CMB.2.raw
  modified_base (379)..(379): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgcctccacgcacgctcatcacagtacaaacactcgctcgttccgggtcctgactccgcttctctgctccatccgtagggaacaaagctcgccctnaccatcgacggggcccaggcagacgatagaatgtgattatcacgtgtcgttcctttagtggtggggcgtggcgtagtttggggtgttcgggcgggtaacggaccaaacgtcgacccgtcgtaggttcgcgcccaagggcctccgcccctcggttcctccgttcgttcccg

SEQ ID NO: 362471 - DNA, 607 bp, Homo sapiens
  misc_feature: GZ8MTXP01EIWLP.15.34.D01.1.454.CMB.2.raw
  modified_base (317)..(317): a, c, t, g, unknown or other
  modified_base (427)..(427): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagccctccacgcacgctcatctacagtacaaacnctcgctcgttccggggtcctgactcccgcttctctcggcctcccattccgttagggaaacaaagcctcgcccctcaccatccgacggggcccaggcagacgatagaatgngtattatcacgtcgtcgtttccgtttagtgggtcgggggtcgttgggtcgttaggttttggggtcggtttccggggcggggtaacgggaacccttaaacggtcgttacccggtccgtacggttccgcgacccgaacggtccgtcccgtcccccgtcggttcctaaccgttccgttccccg

SEQ ID NO: 362472 - DNA, 612 bp, Homo sapiens
  misc_feature: GZ8MTXP01CVY7Q.15.34.D01.1.454.CMB.2.raw
  modified_base (355)..(355): a, c, t, g, unknown or other
  modified_base (381)..(381): a, c, t, g, unknown or other
  modified_base (388)..(388): a, c, t, g, unknown or other
  modified_base (392)..(392): a, c, t, g, unknown or other
  modified_base (423)..(423): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactctacttgtgccttgaggtctggctcagtctctacttctaactaccgccgcctggtaccggcacgaccccgaggccacgcctccacgcacgctcatctacagtaacaaacactcgccttccgttccgggtcctgactccgcttcnctgcctacatcgtagggaaacaagcncgccctnaccntcgacggggccaggcagacgatagaatgtanattactctacgtcggttccgttactttagcggggttggggtccgttgggtaacttggttttgggggcggttcggggacgggaacggggtaaccaaacggtcgacccgttaccggtaagggaccacgggaccccgtaagggtccccttcccggcccccgttaggttcccctaacgttccccggttccccg

SEQ ID NO: 362473 - DNA, 561 bp, Homo sapiens
  misc_feature: GZ8MTXP01D2L7A.15.34.D01.1.454.CMB.2.raw
  modified_base (414)..(414): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgactccgcttctctgctccatccttgggaacaaagctcgccctcaccatcgacggggcccaggcagacgatagaatggtanattactcacgtgtcgttccttagtggtggggcgttggctagtttggggtcgttcgggcgggaacgggaccaaacgtcgaccgtccgtacggttccgacggacccgaacggtccgtccgcccccgtggccctaaccttcgtttccccg

SEQ ID NO: 362474 - DNA, 559 bp, Homo sapiens
  misc_feature: GZ8MTXP01DHB3V.15.34.D01.1.454.CMB.2.raw
  modified_base (319)..(319): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccgcacgaccccaggccagccctccacgcacgctcatctacagtacaaacnctcgctcgttccgggtcctgactccgcttctctggctccatccgtagggaaacaaagctcgccctcaccatcgaccggggccaggcagacgatagaatgtagattatcacgtcgtccgttcctttagtggtggggcgtggtacgtgtttggggtgttcgggcgggaacggaccaaacgtcggaccgtcgtaggttcgacgttacccaaggcctccgccccgtcgcctccgttcgttcccg

SEQ ID NO: 362475 - DNA, 563 bp, Homo sapiens
  misc_feature: GZ8MTXP01DDUUT.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggccacgccctccacgcacgctcatctacagtaacaaacactcgctcgttccgggtccctgactccgcttctctgctccatccgttgggaaacaaagctcgcctcaccatcgacggggccaggcagacgatgaatgtagattatctacgtcgtcgttcctttagtggtgggcgtggtctaggtttggggtgttcgggcgggtaacgggaaccaaacgtcgaccgtccgtaggttccgcgcccgaaggctccggcccctcggttcctaacttccgtcccg

SEQ ID NO: 362476 - DNA, 568 bp, Homo sapiens
  misc_feature: GZ8MTXP01DF1FE.15.34.D01.1.454.CMB.2.raw
  modified_base (524)..(524): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggtcctgactccgcttctctggctcccatccgttagggaacaaagctacgccctcaccatcgacgggggcccaggcagacgatgaatgtgattaatcacgttcgcgtttcctttagtggtcggggcgttggcgtaggtttggggttgttcgggcggtaagggaccgaaacgtcggacccgttcgtacgggttcncgacccgaaggtcctcgcccctcggttcctaacgttccttcccg

SEQ ID NO: 362477 - DNA, 596 bp, Homo sapiens
  misc_feature: GZ8MTXP01CMESB.15.34.D01.1.454.CMB.2.raw
  modified_base (322)..(322): a, c, t, g, unknown or other
  modified_base (438)..(438): a, c, t, g, unknown or other
  modified_base (447)..(447): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccgcacgaccccaggccagccctccacgcacgctcatctacagtaacaaacnctcgctcgttcccggggtccctgactcccgtcttctctcggcctcccattcccgttagggaaacaaacgcctcgcccctcaccactccgacgggggccccaggccagacgattaangtagattanctactggtcgttcgtttagtggtggggcgtggcgttagtttggggtcgttcgggcgggagggaacctaacgttcgtaccgttccgtacggtcacgcccgacggtcctccgtcccccgtcggtccttaccgttccgttcccgttcccccg

SEQ ID NO: 362478 - DNA, 568 bp, Homo sapiens
  misc_feature: GZ8MTXP01EXQPJ.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggtccctgactcccgctttctctcggcctaccatcccgttagggaaaccaaaggcctacgcccctcacccatcgaccggggcccaggcagacgatagaatgtgattatcacgtgtcgttcctttagtggtgggcgtggctagtttgggtggtcgggcggaagggaaccaacgtcgttaccgtcgtacggttcgcgcccgaacggcctccgccccgtcggttacctccttccgttaaccccg

SEQ ID NO: 362479 - DNA, 581 bp, Homo sapiens
  misc_feature: GZ8MTXP01DTEI2.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtccctggaggacagtcacactcacttgtgccttgagtctggctcagtctctacttctaactacgccgcctggtaccggcacgaccccaggccagccctccacgcacgctcatctacagtacaaacactcgctcgttccgggtcctgactccgcttctctggcctccatccgttagggaaacaaacgctgcccctcacccactcgaccgggggcccacgggcagaacggatagaatgtagtacttatctacgttcgtcgttccgtttagtgggttggggtcgttggcgtggtttggggtggttcgggcggaacgggtaccaaacgtcgaccgtccgttaacggcgacgcccgaacggctcccgccccgtcggttcctaaccttcgttccccg

SEQ ID NO: 362480 - DNA, 572 bp, Homo sapiens
  misc_feature: GZ8MTXP01ALPLT.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgagtctggctcagtctctacttctaactacgccgcctggtaccggcacgaccccaggccagcctccacgcacgctcatctacagtacaaacactcgctcgttccggggtcctgactccgcttctctgctccatcctgggaacaaagctgccctcaccatcgacgggggcccaggcagacgatgaatgtgattatcacgtgtccgttcctttagtggtggggcgtggctagtttggggtgttcgggcgggaacgggacccaaacgttcgaacccggttccgtaacgggttccgcggaccccgaagggccctccggccccccgttcgggttaccctccgttccctttccccg

SEQ ID NO: 362481 - DNA, 542 bp, Homo sapiens
  misc_feature: GZ8MTXP01CRTIN.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccgggtcctgatccgcttctctgctccatcccttgggaaacaaagctgccctcaccatcgacgggggccaggcagacgatgaatgtgattatcacgtgtccgttcctttagtggtggggcgtggtctagtttggggtgttcgggcgggaacgggaccaaacgtcgaccgtcgtaggttcgcgcccaaggctcgcccctggttcctcgttcgtccg

SEQ ID NO: 362482 - DNA, 574 bp, Homo sapiens
  misc_feature: GZ8MTXP01AFR2M.15.34.D01.1.454.CMB.2.raw
  modified_base (420)..(420): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccggggtcctgactccgcttctctcggctccatcccgttagggaaacaaagctcgccctcaccatcgaccggggccaggcagacgatgaatgtnacttatcgactgtcgttcctttagtcggtggggcgtggcgtagttgggtggttcgggcgggtaacggaccgttaaacgtcgacccggttccgtacgggttccgcggcccgaagggcctccggtccccctcgggttcctaaccgttccttccccg

SEQ ID NO: 362483 - DNA, 541 bp, Homo sapiens
  misc_feature: GZ8MTXP01BE9U8.15.34.D01.1.454.CMB.2.raw
  modified_base (352)..(352): a, c, t, g, unknown or other
  modified_base (532)..(532): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtagcggcagaccccaggccagcctccacgcacgctcatctacagtacaaacactcgctcttcggggccctgactcgcttctctggctccntccgtgggaacaagctgccctcaccatcgacggggcccaggcagacgatgaatgtgattatcactggccttcctttagtcggtggggtcgtggtcgtagtttggggtgttcgggcgggtacgggaccaaacgttcgaccgtcgttacggttcacgcccgaggcctcgccccgttcggtcnccgttcccg

SEQ ID NO: 362484 - DNA, 535 bp, Homo sapiens
  misc_feature: GZ8MTXP01E3BYE.15.34.D01.1.454.CMB.2.raw
  modified_base (348)..(348): a, c, t, g, unknown or other
  modified_base (414)..(414): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagccctccacgcacgctcatctacagtacaaacactcgctcttccggggtccctgactcgcttcnctgctccatccctgggaacaaagctcgccctcaccatcgaccggggcccaggcagacgatgaatgngattatcactgcgttccttagtcgtgggcgtgcagtttgggtgttcgggcggaacgggtaccaaacgtcggaaccgtcgtaggttcacggcccaaggctcgcccctggcctcgttctcccg

SEQ ID NO: 362485 - DNA, 639 bp, Homo sapiens
  misc_feature: GZ8MTXP01ER6IH.15.34.D01.1.454.CMB.2.raw
  modified_base (321)..(321): a, c, t, g, unknown or other
  modified_base (354)..(354): a, c, t, g, unknown or other
  modified_base (443)..(443): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgccgtggtaccggcacgaccccaggccagcctccacgcacgctcatctacagtacaaacnctcgctcgttcccgggcctgactcccgcttctntcgcctaccatccgttagggaaaccaaagcctcgaccctcaccagtccgacgggggcccaggccaagacgatcgaatcgtagtattacnctaacggtcgttaccgttccgtttagtgggtcggggcgttcggacgttaggttttcgggggtcgttccgggggacggtaacgggggtaaaccttaaacggtcggttacccggttaccgtaacggttacccgacggaccccgtaaggggccttccccggccccgtccgggttacctaacccgtttccgtttccccgg

SEQ ID NO: 362486 - DNA, 558 bp, Homo sapiens
  misc_feature: GZ8MTXP01D9H3W.15.34.D01.1.454.CMB.2.raw
  modified_base (318)..(318): a, c, t, g, unknown or other
  modified_base (527)..(527): a, c, t, g, unknown or other
  modified_base (548)..(548): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactaccgccgcctggtaccggcacgaccccaggccacgccctccacgcacgctcatctacagtaacaacnctcgctcgttccgggtcctgactcccgctttctcgtcgcctccattccgtagggaaacaaagcctcgcccctcaccatccgacggggcccaggccagacgatagaatgtagtattactcacgtgtccgtttcctttaggtgggtggggcgtggtcgttaggtttggggtgttcgggcgggaacggaacaaacgtcgaccgtcgtaggcncgccaagctccgccctgttcncgttctcccg

SEQ ID NO: 362487 - DNA, 627 bp, Homo sapiens
  misc_feature: GZ8MTXP01CSBT0.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactcgccgcctggtaccggcacgaccccaggcccagccctccacgcacgctcatctacagtacaaacactcgctcgttccggggcctgactccgcttctctggcctccatcccgttagggaaaccaaaggctcgcccctcacccatccgacgggggcccaggccagacgatagaaatgtagtattactactacgtcgtacgttcctttagtgggttcgggggcggttgggtaccgttaggttttcgggggtcggtttcgggacggggtaacggggaacccaaacggttcggaccccggttacgtacgggttaccgacggccccgaaacgggtccctcccggtcccccgtcgggttccctaaccgtttccgtttccccgg

SEQ ID NO: 362488 - DNA, 552 bp, Homo sapiens
  misc_feature: GZ8MTXP01AOSZ2.15.34.D01.1.454.CMB.2.raw
  modified_base (318)..(318): a, c, t, g, unknown or other
  modified_base (507)..(507): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctcacgcacgctcatctacagtacaaacnctcgctcttccgggggtccctggactccgcttctctggctaccattcctagggaacaaagctcgccctcaccagtcgaccggggcccaggccagacgagtgaatcgtgattatcacgtgtcgttcttagtggtgggcgtgcgtagttgggtgtcggcggaaggaccttaagtcgaccgtcgtaggttcncggcccaaggcctaaccgcccctcggttcctaaccgttcgtcccg

SEQ ID NO: 362489 - DNA, 557 bp, Homo sapiens
  misc_feature: GZ8MTXP01A2O3O.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaacactcgctcttccggggcctgactccgcttctctggctccatcccgttgggaacaaagctcgccctcaccatcgacgggggcccaggcagacgatagaatgtagattatctacgtcgtcgttcctttagtcggtggggcgtggctagttggggtgttcgggcgggaaggaccaaacgtcggaccgtcgtacggttcgcgacccgaacggcctccgccccgtcggttactccgttcttccccg

SEQ ID NO: 362490 - DNA, 602 bp, Homo sapiens
  misc_feature: GZ8MTXP01BWC3T.15.34.D01.1.454.CMB.2.raw
  modified_base (324)..(324): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgcctggtacccggcacgaccccaggccagccctccacgcacgctcatctacagtaacaaacnctcgctcgttccggggtcctgactcccgcttctctggcctacccacttccgtagggaaacctaaaggcctcgcccctacacccacgtccgaccgggggcccaggcagacgatagaactgtagattatcacgtcgtcgttcctttagtggtgggcgtggtcgttaggtttgggtcggttcgggcgggaacgggaaccttaaacgtcgaccgttccgtaggttccgacggacccgaacggtcctccggtcccccgtcggttcctccgttccgtttccccg

SEQ ID NO: 362491 - DNA, 624 bp, Homo sapiens
  misc_feature: GZ8MTXP01CSJ9R.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctgctcagtctctacttctaactacgccgcctggtaccggcacgaccccaggccacgcctccacgcacgctcatcacagtacaacactcgctcgttccgggtccctgactccgcttctctcggctcccattccgttagggaaacaaagcctacgcccctcacccatcgaccgggggcccaggccaagacgatagaatttgaattactctactgggtccgtttccgtttagtcggttgggggccgtgggtcgttaaggttttggggtggtttaccgggcgggaacgggaacccaaacgttccggtaacccgttccgttaacgggccaccgccccgaacggtcccgtcccggtccccccgttcgggtccttacccgtttccttcccgtttcccccccg

SEQ ID NO: 362492 - DNA, 563 bp, Homo sapiens
  misc_feature: GZ8MTXP01ATFDZ.15.34.D01.1.454.CMB.2.raw
  modified_base (485)..(485): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacactcgctcttccgggcctgactccgcttctctcggcctccattcccgttagggaaaccaaagcctcgacccctcgacccacgtccgaccgggggcccagggccagacgatgaatgtgtattatcacgtgcgttccttagtgtgggcgtggctagtttggggtgttcgggngggaaggaaccaaacgtcgaccgtcgtaggttccgacgcccgaaggcctccgcccctcggttctaaccgttcgtcccg

SEQ ID NO: 362493 - DNA, 559 bp, Homo sapiens
  misc_feature: GZ8MTXP01COUXL.15.34.D01.1.454.CMB.2.raw
  modified_base (419)..(419): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggaccgcacgaccccaggccagcctccacgcacgctcatctacatacaaacactcgctcgttccgggcctgactccgcttctctgctaccatccgtagggaaacaaagctcgccctcaccactcgacggggcccaggcagacgatagaatgtanattactcacggtgtacgtttcttagtgggtgggtcgtggtactggtttggggtggtcgggacgggaagggaaccaaacgtcgaccgtcgtaggttcgcgttcccgaaggcctccgccccgtcggcctccgttcgttcccc

SEQ ID NO: 362494 - DNA, 582 bp, Homo sapiens
  misc_feature: GZ8MTXP01DKKIV.15.34.D01.1.454.CMB.2.raw
  modified_base (333)..(333): a, c, t, g, unknown or other
  modified_base (427)..(427): a, c, t, g, unknown or other
  modified_base (433)..(433): a, c, t, g, unknown or other
  modified_base (534)..(534): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactacgccgctggtaccgcacgaccccaggccagcctccacgcacgctcatcacagtacaacactcgctcgttccgggtcccngactccgcttctcgtgcctccacttcccgtagggaaaccaaaggcctcgccctcacccatcggaccgggggcccaggccagacgatgaatgtanattacnctacgtcgtcgttccttagtggtggggtcgtggtcgttagtttcggggtcgttcgggcgggaacgggaaccaacgtcggacccgttacgtacgggttaccncggcccgtaaggcctcccgtccccgtcgttctaaccttccgttccccg

SEQ ID NO: 362495 - DNA, 540 bp, Homo sapiens
  misc_feature: GZ8MTXP01BGJ77.15.34.D01.1.454.CMB.2.raw
  modified_base (412)..(412): a, c, t, g, unknown or other
  modified_base (529)..(529): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctcttccgggtcctgactccgcttctctgctccatctagggaacaaagctcgccctcaccatcgacggggccaggcagacgatgaatgtgattncacgtcgtcgttcctttagtggtggggcgtggctagtttggggtgttcgggcgggtaagggaccaaacgtcgaccgtcgtacggttcgacgccgaaggcctcgccccgtcggttccnccgttctcccg

SEQ ID NO: 362496 - DNA, 583 bp, Homo sapiens
  misc_feature: GZ8MTXP01ETUUB.15.34.D01.1.454.CMB.2.raw
  modified_base (318)..(318): a, c, t, g, unknown or other
  modified_base (446)..(446): a, c, t, g, unknown or other
  modified_base (539)..(539): a, c, t, g, unknown or other
  modified_base (571)..(571): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttcaactacgccgctggtaccggcacgaccccaggcccagccctccacgcacgctcatctacagtacaaacnctcgctccgttccgggtccctgactcccgctttctcgtcggccctaacccattcccgttaggggaaaccaaaggccttcgcccctcacccagtccgaccgggggcccagggcagacgatagaatggtnattatcactgtcgttcctttagtggtggggcgtggctgtttgggtggttcgggcggaagggaaccaaacgtcgttaccgtccgtagggttccncgcccgaagggccttccgcccccttcggaccnccttcgtccccg

SEQ ID NO: 362497 - DNA, 537 bp, Homo sapiens
  misc_feature: GZ8MTXP01C6C00.15.34.D01.1.454.CMB.2.raw
  modified_base (472)..(472): a, c, t, g, unknown or other
  modified_base (501)..(501): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgactccgcttctctggctccatcctgggaacaaagctgccctcaccatcgacggggcccaggcagacgatgaatgtgattatcacgtcgtccgttcctttagtggtggggcgtggctgtttgggtgtcgggnggaaggaccaaactcgaccgtctggttcncgccgaagctcgcccctcggttactcgttcgtcccc

SEQ ID NO: 362498 - DNA, 558 bp, Homo sapiens
  misc_feature: GZ8MTXP01EFISU.15.34.D01.1.454.CMB.2.raw
  modified_base (348)..(348): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgacccccaggccagccctccacgcacgctcatctacagtacaaacactcgctcgttccgggtcctgactccgcttcnctgcctcccatccgttagggaaacaaagctacgcccctcaccatccgacgggggcccaggcagacgatagatgtgattatcacgtgtcgttcctttagtggtggggcgtggtactggtttgggtgttcgggcgggaacgggaccaaacgtcgaccgtccgtaggttcgcgcccgaaggctccgccccgtcggttcctccgttcgttcccg

SEQ ID NO: 362499 - DNA, 598 bp, Homo sapiens
  misc_feature: GZ8MTXP01ERB1L.15.34.D01.1.454.CMB.2.raw
  modified_base (433)..(433): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgccctccacgcacgctcatcacagtacaaacattcgctcgttccgggtcctgactccgcttctcgtggcctacccatcccgttagggaaaccaaagctcgccctcaccacgtcgaccggggccaggcaagacgatagatgtagattanctacgtcgtcgttcttagtggtggggcgtggcgtaggtttggggtcggttcgggacgggtaacgggtaacccgttaaacgtcggttacccgtcgttaacggccgacggccccgaagggtccctccggtaccccccgtcgggttcctaaccgttccgttaaccccg

SEQ ID NO: 362500 - DNA, 560 bp, Homo sapiens
  misc_feature: GZ8MTXP01BF9ZS.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttcccgggggtccctgactcccgtcttctctcggctcccatccgttagggaaacaaagctcgccctcaccatcgacggggccaggcagacgatgaatgtagattatcacgtcgtcgttcctttagtggtggggcgtggtctagttggggtgttcgggcgggtaacgggaccaacgtcgaccgtcgtaggttcgcgcccgaaggcctccgccccgtcggttcctcttcgtcccg

SEQ ID NO: 362501 - DNA, 546 bp, Homo sapiens
  misc_feature: GZ8MTXP01C42B4.15.34.D01.1.454.CMB.2.raw
  modified_base (316)..(316): a, c, t, g, unknown or other
  modified_base (394)..(394): a, c, t, g, unknown or other
  modified_base (402)..(403): a, c, t, g, unknown or other
  modified_base (405)..(405): a, c, t, g, unknown or other
  modified_base (407)..(407): a, c, t, g, unknown or other
  modified_base (412)..(412): a, c, t, g, unknown or other
  modified_base (430)..(430): a, c, t, g, unknown or other
  modified_base (454)..(454): a, c, t, g, unknown or other
  modified_base (497)..(497): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctccgttccgggtcctgactccgcttctctcgctccatccgtagggaacaagctcgcctcacatcgacgggccngcagacannangnattancagtcgtcgttctttagnggtgggcgtggtactggtttgggngttcgggcggaacgggacaaacgtcgacgtaccgtaggttccncggaccctaacggcctccgccccgtcggttacctccgttcttaaccccg

SEQ ID NO: 362502 - DNA, 656 bp, Homo sapiens
  misc_feature: GZ8MTXP01EVNWW.15.34.D01.1.454.CMB.2.raw
  modified_base (320)..(320): a, c, t, g, unknown or other
  modified_base (340)..(340): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttactaactacgccgcctggtacccggcacgaccccaggcccacgcctccacgcacgctcatctacagtacaaacnctcgctcgttccgggcctgntcccgcttctctggccctccattcccgttagggaaacaaacggtcctacgcccctacacccacgtaccggacccgggggcccaggaccgaggaaacgatagtaaatggtagtatttactacctacggttcggttccgtttaccttttaggtggggttcgggggtcgttcgggtacgttggtttggggttcggttcggggcgggaacgggtaacccttaaacggtcggttaacccggtccgtaaggggttccaccggaccccgaaggtcccgtcccggtcccccggttccggttacctcccgttcccgtttcccccg

SEQ ID NO: 362503 - DNA, 577 bp, Homo sapiens
  misc_feature: GZ8MTXP01AI56M.15.34.D01.1.454.CMB.2.raw
  modified_base (312)..(312): a, c, t, g, unknown or other
  modified_base (343)..(343): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactcgccgctggtaccgcacgaccccaggccacgcctccacgcacgctcatcacagtacaaacnctcgctcgttccgggtcctgactccgcttcncgtcgctccatccgtagggaaacaagctcgccctcacccatcgaccggggccaggcagacgatagaagtgtagtattatctacgtgtccgtttccttagtgggtggggcgtgggtctggtttggggtcggttcgggcgggtaacgggaacccaaacgtcggttacccgtaccgtaggttccgacgcccgaacgggccctccggccccgttcggttcctccgttccgttccccgg

SEQ ID NO: 362504 - DNA, 562 bp, Homo sapiens
  misc_feature: GZ8MTXP01A3Y0C.15.34.D01.1.454.CMB.2.raw
  modified_base (316)..(316): a, c, t, g, unknown or other
  modified_base (477)..(477): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggccagcctccacgcacgctcatctacatacaaacnctcgctcttccgggtcctgactccgcttctctgcctccattcccgtagggaaacaaacgctcgcccctacaccactcgaccggggcccaggcagacgatgaatgtagattatacacgtcgcgttccttagtggtgggtcgtggcgtgttgggtgttcgggngggaacggaccgaaacgtcggaccgtcgtacggttcgacgcccgaaggtcctcgcccccgtcggttcctaaccgttccgttcccg

SEQ ID NO: 362505 - DNA, 555 bp, Homo sapiens
  misc_feature: GZ8MTXP01DVJOZ.15.34.D01.1.454.CMB.2.raw
  modified_base (435)..(435): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtgccttgagtctggctcagtctctacttctaactacgccgcctggtaccgcacgaccccaggccagcctccacgcacgctcatcacagtacaaacactcgctcgttccgggtccctgactccgcttctctgctccatccgtagggaaacaaagctcgccctcaccatcgacgggcccagcagacgatgaatgtagattatcacgtcgtcgttctttagnggtggggtcgtggtcgtagtttcggggtgttccgggcgggaacgggaaccaaagttcgaccgttcacggttcgcgcccgaagggccctcgccccgtcggttcctaaccgttccttcccgg

SEQ ID NO: 362506 - DNA, 524 bp, Homo sapiens
  misc_feature: GZ8MTXP01BZ39T.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaacactcgctcttccggggtccctgatcccgcttctctgctccatcctgggaacaaagctgccctcaccatcacggggccagcagacgatgaatgtacgattatcactgtcgtcctttagtgtggggcgtggctagttgggtgttcggcggaagggaccaaactgaccgtctaggttcacgcccaaggctcgcccctggttactccgttctccg

SEQ ID NO: 362507 - DNA, 559 bp, Homo sapiens
  misc_feature: GZ8MTXP01DYDY4.15.34.D01.1.454.CMB.2.raw
  modified_base (318)..(318): a, c, t, g, unknown or other
  modified_base (349)..(349): a, c, t, g, unknown or other
  modified_base (488)..(488): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgtccttgaggtctggctcagtctctacttctaactaccgccgcctggtaccgcacgaccccaggccagccctccacgcacgctcatctacagtacaaacnctcgctcgttccgggtcctgactccgcttcncgtcgcctacctacgtccgttagggaaacctaaacgcctcgcccctcaccacgtccggaccggggcccaggcagaacgatagaatgtatattactctagtcgtcgttccttagtggtgggcgtgcgtgttggtgtcggnggaacgaacagtcgaccgtcgcgttcgcgttcccgaaggcctccgtcccctggttcctccgttcgttcccg

SEQ ID NO: 362508 - DNA, 562 bp, Homo sapiens
  misc_feature: GZ8MTXP01BO535.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggcccagccctccacgcacgctcatctacagtacaaacactcgctcgttccggggtccctgactccgcttctctggcctcccattccgttaggggaaacaaaggctacgcccctcacccatcgaccgggggccaggcagacgatgaatgtagattatcacgtgtacggttcctttagtggtggggtcgtggcgtgtttggggtgttcgggcgggaagggacccaaagtcgaccgtccgtaggttcgcgcccaaggctccgcccctcggttctcgttcgtcccg

SEQ ID NO: 362509 - DNA, 675 bp, Homo sapiens
  misc_feature: GZ8MTXP01DWDZU.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtccctggaggacagtcacactctacttgtcgtccttgaggtctggctcagtctctacttctaactacgccgccgtggtaccggcacgaccccaggccagccctccacgcacgctcatctacaagtaccaaactacctcgtccttccggttcccggtcctagtctcccgtccttcgtcgtcgcctacctacgttccggttaacggaaacaacgtcctccgcccctacaccgtcgaccggggccggggaccaggaccagtaacgtagtagaagttggtataactttcacttacgggtcgttttaccggttacttttagggtcgggggttcgggtcgggttcgtacgggttttggggtttcgggggttcgggttaccggggacggggaaacggtaaacccttaaacggccgttacccgttacggtaacgacgcccgaccggtaacgtccgtccccgtcccggttcgacctcccgttcgtttcccccgg

SEQ ID NO: 362510 - DNA, 546 bp, Homo sapiens
  misc_feature: GZ8MTXP01BUT1F.15.34.D01.1.454.CMB.2.raw
  modified_base (420)..(420): a, c, t, g, unknown or other
  modified_base (505)..(505): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggccagccctccacgcacgctcatcacagtacaaacactcgctcgttccgggtcctgactccgcttctctcgcctccatccgtaggaaacaagctcgccctcacatccgacgggcccaggcagacgatgaatgagattancacgtgtccgttcttagtggtgggcgtgtacgtgttggggtcgttcgggcggaaggtaaccaaacgtcgaccgtcgaggttccgngacccgaaggccctcgccccctggttctaaccgttctcccg

SEQ ID NO: 362511 - DNA, 589 bp, Homo sapiens
  misc_feature: GZ8MTXP01DIR1V.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccagccagccctccacgcacgctcatctacagtacaacactcgctcgttccgggtcctgactccgcttctcgtcgcctcccattcccgttagggaaaccaaacgctcgccctcacccatccgacgggggccaggcagacgatgaatgtagattactctacgtcgtcgtttacctttagtggtggggtcgttggcgttaggtttggggttggttcggggcggtaacggggaaccttaaacggtcggttaccgtcggtacgttcgaccgaccgaacggcctccggccccctcggttcctaaccgttccgttccccg

SEQ ID NO: 362512 - DNA, 567 bp, Homo sapiens
  misc_feature: GZ8MTXP01DM4G3.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggcccagccctccacgcacgctcatctacagtacaaacactcgctcgttccgggtcctgactccgcttctctcggctccatccgttagggaaacaaagctcgcccctcaccatcgacgggggcccaggccaagacgatagaatgtagtattatccacgtcgtccgttcctttagtggtggggcgtggcgtagtttggggtgttcggggcggaaggaaccaaacgtcggaccgtccgtaggttcgcgacccgaaggcctccgcccccgtcggttcctaaccgttctccccg

SEQ ID NO: 362513 - DNA, 581 bp, Homo sapiens
  misc_feature: GZ8MTXP01CX3I3.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttactaactacgccgcctggaccggcacgaccccaggccagccctccacgcacgctcatctacaagtaacaaacactcgctcgttcccggggtccctgactccgcttctctgctcccatcccgttagggaaacaaagcctcgcccctcaccatccgaccgggggcccagggccaggaacgatagaaagtgtagtattactcacgtgtccgttactttagtggtggggcgtggacgtagtttggggtcgttcgggcggaacgggaacccaaagttcgacccgtccgtaggttccgacgacccgaaggcctcgcccccgtggttacctcttccgttcccg

SEQ ID NO: 362514 - DNA, 562 bp, Homo sapiens
  misc_feature: GZ8MTXP01EBG1O.15.34.D01.1.454.CMB.2.raw
  modified_base (474)..(474): a, c, t, g, unknown or other
  modified_base (491)..(491): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtcctgactccgctttctcgtggcctcccatccgttagggaaaccaaagcctacgcccctcaacccactcgaccgggggcccaggccaagtacgatgaagtgtagattaatctacgtcgtcgtttcctttagtggtgggcgtggntagttgggtgttcgggnggaagggacaaacgtcgaccgtcgtaggttcgcgcccgaagctccgcccccgtggttcctcgttcttcccg

SEQ ID NO: 362515 - DNA, 526 bp, Homo sapiens
  misc_feature: GZ8MTXP01EFKJH.15.34.D01.1.454.CMB.2.raw
  modified_base (317)..(317): a, c, t, g, unknown or other
  modified_base (470)..(470): a, c, t, g, unknown or other
  modified_base (504)..(504): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgccgtggtacccggcacgaccccaggccagcctccacgcacgctcatctacagtacaaacnctcgctcgttccggggtcctgactccgcttctctgcctccatcccgtagggaacaaagctcgccctcaccatcgacggggcccaggcagacgatgaatgtgattatcacgtcgtcgttcctttagtggtgggcgtggctgtttgggtgtcggnggaacggacatcgaccgtctggcgcgccaaggcnccgcccgtcgctcttcgtcccg

SEQ ID NO: 362516 - DNA, 585 bp, Homo sapiens
  misc_feature: GZ8MTXP01AUFM2.15.34.D01.1.454.CMB.2.raw
  modified_base (319)..(319): a, c, t, g, unknown or other
  modified_base (492)..(492): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacnctcgctcgttccggggccctgactccgcttctcgtcggcctaccattccgtagggaaacaaagctcgccctcaccatcgaccggggccaggcagacgatagaatgtagattactcacgttcgtacgttcctttagtcggtggggcgtgggtctaggtttggggtcgttcgggnggaacgggaaccttaaacgtcgaccgtccgtaggttccgcgacccgaaggtcctaaccgtccccctcggttcctaaccgttccgttaaccccg

SEQ ID NO: 362517 - DNA, 609 bp, Homo sapiens
  misc_feature: GZ8MTXP01B1U2Z.15.34.D01.1.454.CMB.2.raw
  modified_base (340)..(340): a, c, t, g, unknown or other
  modified_base (433)..(433): a, c, t, g, unknown or other
  modified_base (482)..(482): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatctacagtaacaaacactcgctccgttccggggtcccngactcccgcttctctcggcctccaacttccgttaggggaaaccaaacgctcgcccctcacccatccgacggggcccaggcagacgatgaatgngattatcacgtgtcgttccttagtggtggggcgtgtcgtagtttggggngtttcgggcgggaacgggaacccttaaacgtacggttacccggtacccgtaaggggttcccacggcccccgtaaagggcctcccggccccccgttccgggttcctaacccgtttccgtttcccccgg

SEQ ID NO: 362518 - DNA, 539 bp, Homo sapiens
  misc_feature: GZ8MTXP01A6GMI.15.34.D01.1.454.CMB.2.raw
  modified_base (497)..(497): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctcgttccggggccctgactccgcttctctggctcccatccctgggaaacaaagctgccctcaccatcgacgggggcccaggcagacgatgaatgtgattagtcacgtgcgttccttagtggtgggcgtggctgttgggtgttcggcgggaaggacaaacgtgaccgtcgtagggttcncgcccgaaggcctccgccccgtcggttactccttcgttcccg

SEQ ID NO: 362519 - DNA, 547 bp, Homo sapiens
  misc_feature: GZ8MTXP01A1DGY.15.34.D01.1.454.CMB.2.raw
  modified_base (507)..(507): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgttccggggtcctgatccgcttctctcggctccatccttgggaaacaaagctcgccctcaccatcgacggggcccaggcagacgatgaatgtgattatcacgtgtcgttcctttagtggtgggcgtggctagtttgggtgttcgggcgggaacggaccaaacgtgacccgtcgtacggttcncgcccgaaggctccgcccctcggttcctcgttccgtcccg

SEQ ID NO: 362520 - DNA, 535 bp, Homo sapiens
  misc_feature: GZ8MTXP01EMSIW.15.34.D01.1.454.CMB.2.raw
  modified_base (313)..(313): a, c, t, g, unknown or other
  modified_base (345)..(345): a, c, t, g, unknown or other
  modified_base (410)..(410): a, c, t, g, unknown or other
  modified_base (499)..(499): a, c, t, g, unknown or other
  modified_base (524)..(524): a, c, t, g, unknown or other
tcagtctacgtagccacgaccggtgctcgatttagatcgtctgtgttgggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacnctcgctcttccggggtccctgactccgcttcnctggctccatccttgggaacaaagctgccctcaccatcacgggggcccaggcagacgatgaatgngattatcgactgcgtcctttatgtggggcgttggctagtttggggtgttcgggcgggaaggaccaaagtcgaccgtccgtaaggttcgngcccaaggctcgccccctggttccncgttccgtccg

SEQ ID NO: 362521 - DNA, 596 bp, Homo sapiens
  misc_feature: GZ8MTXP01AH7JB.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgccgtggtaccggcacgaccccaggccacgcctccacgcacgctcatcacagtacaacactcgtctccgttccgggtccctgactccgcttcgtctcgctaccactccgttagggaaacaaacgctcgccctacaccacgtccgaccggggcccagggaccagacgatgaatgtagtattatccacggttcgtcgttcctttaggtgggtggggtcgtggtacgttggtttgggggtcggttcggggcggaacgggaaccttaaacggtccggttaccgtccggtacgttccgacgcccgaaggtccgtccggcccctcggttcctccgttccgttcccg

SEQ ID NO: 362522 - DNA, 613 bp, Homo sapiens
  misc_feature: GZ8MTXP01ATWG8.15.34.D01.1.454.CMB.2.raw
  modified_base (339)..(339): a, c, t, g, unknown or other
  modified_base (351)..(351): a, c, t, g, unknown or other
  modified_base (398)..(398): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactccgccgccgtcggtacccggcacgaccccaggccagccctccacgcacgctcatctacagtacaaacactcgctccgtccgggtccngactccgcttcncgtcggcctaccacttcgtagggaaacaacgcctcgcccctacaccncgtaccggaccggggccaggccaagacggatagaaatgtagtattacgtcacggtcgtccgtttaccgtttaggtcggggtggggcgttggtacgttggtttcggggtcggttcggggacgggtaacgggaaccttaaaggtccgttaccggtcgtaacggccgacgacccgaacggccgtcccgccccgtcggttacctccgttccgttccccg

SEQ ID NO: 362523 - DNA, 597 bp, Homo sapiens
  misc_feature: GZ8MTXP01E08UX.15.34.D01.1.454.CMB.2.raw
  modified_base (312)..(312): a, c, t, g, unknown or other
  modified_base (434)..(434): a, c, t, g, unknown or other
  modified_base (441)..(441): a, c, t, g, unknown or other
  modified_base (461)..(461): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtcgccttgaggtctggctcagtctctacttctactacgccgctggtaccgcacgaccccaggccagcctcacgcacgctcatctacagtacaaacnctcgcttccgttccggggtcctgactcccgtcttctctcggtcctcccacttcccgttagggaaacaaacgctcgcccctcaccctagtcggaccggggcccaggacagaacgatcgaatgngtattancacgtgtcgttcctttaggnggtgggcgtggtcgttaggtttgggtaggtcgggtagggaacgggtaaccaaacgtcgggaccgtacgtacggttcgacgacccgtaaggccctaaccggccccctacgggttcctaaccgttcccgttaaccccg

SEQ ID NO: 362524 - DNA, 708 bp, Homo sapiens
  misc_feature: GZ8MTXP01DEUNF.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactctacttgtgtccttgaggttctggctctagttctctacttctaactcgccgcgtggaccgcacgacccagccacgccctccacgcacgctcactctaacaagtaacaaactctcgccttccgttcccggggtcctaggactcccgtcctttcgtcgtcggtcccttaacccacgttcccgttaaggggaaaacctaaacggtcccttaccggacccccttacgaaaccccgtacgttacccgggaacccggggggccccaagggacccaagggtaaccgtaagtagtaaagttggtagtaacttactacgtaacggttcgttaccggtttaccgtttaggtcggggtcggggtcgtcgggttaccgttagggttttgggcggtttccggggcgggtaaacggtaaccgttaaacgtcggacccgttcggtaacgttccgacgttacccgaaggtcctcccgccccgtggttccctaaccgttcgttaaccccg

SEQ ID NO: 362525 - DNA, 585 bp, Homo sapiens
  misc_feature: GZ8MTXP01DCENA.15.34.D01.1.454.CMB.2.raw
  modified_base (320)..(320): a, c, t, g, unknown or other
  modified_base (340)..(340): a, c, t, g, unknown or other
  modified_base (382)..(382): a, c, t, g, unknown or other
  modified_base (422)..(422): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgagtctggctcagtctctacttctaactacgccgcctggtaccgcacgaccccaggccacgcctccacgcacgctcatctacagtacaaacnctcgctcgttccgggcctgntccgcttctcgtgctcactcctgggaaacaagctcgcccctnaccatcgaccggggccaggcagacgatgaatgtcattacncacgtgtccgttctttagtggtggggcgttggaccgttgtttggggtggttcgggcgggaacgggaaccttaaaccggtcgacccggttaccgtaacggttcgacggaccccgtaaggcccgttccggtcccccgtcggttccaacccgtttccttcccccgg

SEQ ID NO: 362526 - DNA, 583 bp, Homo sapiens
  misc_feature: GZ8MTXP01D1YEO.15.34.D01.1.454.CMB.2.raw
  modified_base (320)..(320): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagccctccacgcacgctcatctacagtacaaacnctcgctcgttccgggtcctgactccgcttctcgtgcctaccatccgtagggaaacaaagctcgccctcaccatcgacggggccaggcagacgatagaatgtagaattactcacgttcgtaccgtttcctttaggtcgggtcggggtcggttgggtcgttaggtttggggtcggttcgggcggggtaacgggaccttaaacgtcggaccgtccgtaacggttcacgcccgaaggcctccgcccctcggttctccttccgtcccg

SEQ ID NO: 362527 - DNA, 605 bp, Homo sapiens
  misc_feature: GZ8MTXP01DQNY0.15.34.D01.1.454.CMB.2.raw
  modified_base (314)..(314): a, c, t, g, unknown or other
  modified_base (466)..(466): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccgcacgaccccaggccagcctccacgcacgctcatctacatacaaacnctcgcttcgttccgggtcctgactccgtcttctctcggcctccacttccgtagggaaaccaaaggtctacgccctacaccagtccgacggggcccaggccagacgagtagatgtgtattagccacgttcgtcgtttcctttagtgggtcggngtggtcgttggtttcgggttagtccggggcgggtaacgggaacccttaaacgttccggaccgttcggtacggttaccgaccggacccgaacggtcccgttccggcccccgtcggttaccctccgttcccgttaaccccg

SEQ ID NO: 362528 - DNA, 959 bp, Homo sapiens
  misc_feature: GZ8MTXP01DDCII.15.34.D01.1.454.CMB.2.raw
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccgagggtgaggtgcgaggtggtggaagtcgtgggggaggcttggtccaggccgtgggggtccctgagactctcgtgtgcacgtcctcgtggtattcgagttactaagtaaactacgtaggtaagttaaggttcggggtccccgccgaagggtcccgtacccgggaaggggggaacggggtcgtaggggtaggtgggaagttcggaccctaaaagttaagtaccggaaaacccgaaagggaaaccgggtaaagtaacgtaaaacttaaaacagttaccgtaagttcggggttacgggtccttccggttgggtacgggacccgggaaccggggggtaccccgttaaactttaccccgtaaccttaaacttcccccgtaaccccggaaaagggaaacccggtaaaacccgaaaacccccgggaacccgtaaaaaaggttaaacctttacccggttaaaagggtttacggtttaaatttttaaccgggaaaacccgttaaaaaagtttccggggtaaaaaaccccgtaccggtaacccggtaaagggaaacccggaaccccgggtaaaccccggaaaccggtaacccgggtaccgggttacggtttaacgggtttaacggtttaaacggtttacccgggggtggggttaccggggggaaccggggggtaacggggttacgggtttagggtttagggttttaacggtttacggggttaacgttttacccggggttcggggttacccgggggtaacccgggttaacccgggggttccccg

SEQ ID NO: 362529 - DNA, 640 bp, Homo sapiens
  misc_feature: GZ8MTXP01AZ3K3.15.34.D01.1.454.CMB.2.raw
  modified_base (324)..(324): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgcctggtacccgcacgaccccaggcccagccctccacgcacgctcatctacagtaacaaacnctccgcttccgttcccgggggtccctgactcccgtcttctctcgctacccattcccgtagggaaaccaagcctcgcccctcaccacgtccgaccggggcccaggcaagacgatagaatgtacgtattactcacgtgtccgttcctttagtcgggtcgggacgttgggtacgttggtttgggggtcgttccggggcgggtaacgggtaacccgttaaacgtcggttacccggtccgtaacgggttcccgaccggaccccggtaacggtcccgtccccggtcccccgtcgggttcctaacccgttcccgtttccccgg

SEQ ID NO: 362530 - DNA, 554 bp, Homo sapiens
  misc_feature: GZ8MTXP01A6HH4.15.34.D01.1.454.CMB.2.raw
  modified_base (409)..(409): a, c, t, g, unknown or other
  modified_base (501)..(501): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtggggggtccctgagactctcctgtgcagcctctggattcagttctagtaaatactggataagttgggtccgccaggctccgaggggaaggggctggagtggatggccaatatgaaccaagacggaagtgataaacatcatgtgggctctgtgcaggggccattcactatctcaganacaacgcaaagatctagtgtatttgacaaatgaaacagcctgagagccgacgacgacggctgtgtattacgtgttggcggggtagggccggnggttggtaattggtaattacgtttcgttcgggggtccgaagggggtaaccccg

SEQ ID NO: 362531 - DNA, 565 bp, Homo sapiens
  misc_feature: GZ8MTXP01EIWSJ.15.34.D01.1.454.CMB.2.raw
  modified_base (474)..(474): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagcctccacgcacgctcatctacagtacaacactcgctcttccgggtcctgactccgcttctctgcctccatccgtagggaaacaaacgctcgccctcaccatcgacggggccaggcagacatagaatgtgtattagtcacgtgtcgttcctttagtggtggggcgtggtcgtagtttggggtgttcgggngggtaacgggaaccaaacgtcgaccgtccgtaggttccgacgcccgaacggtcctccggtcccccgtcggttcctaaccgttcgttccccg

SEQ ID NO: 362532 - DNA, 575 bp, Homo sapiens
  misc_feature: GZ8MTXP01CPMEG.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctccgttccgggtccctgactcccgcttctcgtcggcctcccattccgtagggaaacaaagctcgccctcaccactcgaccggggcccaggcagacgatgaatgtagattacgtacctacgtggtccgtttccttagtcgggtggggcgttggtcgtaggtttgggtggttcgggcgggtaacgggaccaaacgttcgaccgttccgtacgttcgcggcccaaggcctccgcccgtcggttcaaccgttcttcccg

SEQ ID NO: 362533 - DNA, 675 bp, Homo sapiens
  misc_feature: GZ8MTXP01EIN30.15.34.D01.1.454.CMB.2.raw
  modified_base (268)..(268): a, c, t, g, unknown or other
  modified_base (311)..(311): a, c, t, g, unknown or other
  modified_base (337)..(337): a, c, t, g, unknown or other
tcagtctacgtagccacgaccggtgctcgatttagatcgtctgtgttggggttgggaagcctgagaacacttagccttcatgagtgtcccaccatggcctggatgatgcttctcctcggactccttgcttatggatcaggagtggattctcagactgtggtgacccaggagccatcgttctcagtcgtcccctggagggacagtcacactcacttgtcgccttgagtctggctcagtctctacttcaactcgccgtcctggtacccgnacgaccccaggccagcctccacgcacgctcatctacagtacanctgctcgtccggctgactccgcttcncgtcgctaccagtccgtagggaaacaacgtcctcgccctacgaccgtacgtccggaccggggtccagggtacacggtaacgtagtacgaacgtgtacgtacttacgtccgtacgggttcgttacgttaccgtttaggtcgggtcggggtcgttacggtcgttacgggtttacggggtccggttaccgggtaccggggtaaaccggtaacccgttaaacgggttccggttaaccccggttaccgttaacggggttacccgttacccgggttaccgggtaaaccgtcccgttaacccggtcccccgttggttacccttaaccgttcccgtttaaccccgg

SEQ ID NO: 362534 - DNA, 554 bp, Homo sapiens
  misc_feature: GZ8MTXP01D2AIA.15.34.D01.1.454.CMB.2.raw
  modified_base (515)..(515): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaaactacgccgctggtaccggcacgaccccaggccagccctccacgcacgctcatctaacaagtacaaaacactcgctcgttccggggtccctgactccgcttctctggctaccatccgtagggaaaccaaagctgccctcaccatcgacgggggcccaggcaagaacgatagatgtagattaatcacgtgtcgttcctttagtggtgggcgtggctgtttggggtgttcgggcggaagggacaaacgtcgacccgtctaggcncgacccgaagccgtccgcccctcggctaaccttcgtccg

SEQ ID NO: 362535 - DNA, 569 bp, Homo sapiens
  misc_feature: GZ8MTXP01AXHTR.15.34.D01.1.454.CMB.2.raw
  modified_base (319)..(319): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacnctcgctcgttccggggtcctgactcccgcttctctggcctaccatcccgttgggaaaccaaagctcgcccctcacccagtccgacgggggcccaggcagacgatgaatgtagattatcacgtcgtcgttccttagtggtggggtcgtggtcgtgtttggggtcgttcgggcgggtaacgggaacccaaacgtcgacccgtcgtaggttcgcgcccgaaggcctccgcccctcggttcctcttccgtcccg

SEQ ID NO: 362536 - DNA, 544 bp, Homo sapiens
  misc_feature: GZ8MTXP01ADA2B.15.34.D01.1.454.CMB.2.raw
  modified_base (319)..(319): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctcgttccggggtcctgactccgcttctctggctccatccgttagggaaacaaagctcgccctcaccatcgacggggccaggcagacgatagaatgtgtatatcacgtgcgttcttagtggtgggcgtggtctagtttgggtgttcggcgggaacggaccaaacgtcgaccgtcgtacggttcgcgccgaaggcctcgcccctcggttctcttcgttcccg

SEQ ID NO: 362537 - DNA, 626 bp, Homo sapiens
  misc_feature: GZ8MTXP01EGNC1.15.34.D01.1.454.CMB.2.raw
  modified_base (280)..(280): a, c, t, g, unknown or other
  modified_base (316)..(316): a, c, t, g, unknown or other
  modified_base (595)..(595): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtcgtccttgaggtctggctcagtctctacttctaactacgccgcgtggtaccgcacgacccnggccacgcctccacgcacgctcatcacagtacaacnctcgctccgttccgggtcctgactcccgtcttctcgtcggccctacctattcccggttaggggaaaaccctaaagccctccgcccctacacccgtacgtccgggacgggggccccaagggccaagaacgatagtaaatgtagtattactctacggttcgttcgttaccgtttagtgggtcggggtcgttgggtacgttgggtttcggggtcggttccgggcggggtaacggtaaccaaacgtcggttaccgtcgtacgttcgacgaccgaacgggtccnccggtccccgtgttacctccttcgttccccg

SEQ ID NO: 362538 - DNA, 538 bp, Homo sapiens
  misc_feature: GZ8MTXP01ENHXQ.15.34.D01.1.454.CMB.2.raw
  modified_base (323)..(323): a, c, t, g, unknown or other
  modified_base (341)..(341): a, c, t, g, unknown or other
  modified_base (351)..(351): a, c, t, g, unknown or other
  modified_base (381)..(381): a, c, t, g, unknown or other
  modified_base (387)..(387): a, c, t, g, unknown or other
  modified_base (415)..(415): a, c, t, g, unknown or other
  modified_base (439)..(439): a, c, t, g, unknown or other
  modified_base (468)..(468): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgccgtggtacccggcacgacccccaggcccagccctccacgcacgctcatcacagtacaacnctcgctcgttccgggccngctccgcttnctgctccatcctgggaaacagctcgccctnactacncgacggggccaggcagacgatagaatgngtattatcactgtcgttactttgnggtgggcgtggcgttagttgggtgtcggngggaacggacaacgtcgaccgtcgtgttcgcgaccgtaagcctccgcccctggttcctcgttcgttcccg

SEQ ID NO: 362539 - DNA, 606 bp, Homo sapiens
  misc_feature: GZ8MTXP01BUK11.15.34.D01.1.454.CMB.2.raw
  modified_base (320)..(320): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagttctctacttctaactaccgccgcctggtacccggcacgaccccaggcccagccctccacgcacgctcatcacagtacaaacnctcgcttcgttccgggcctgactccgcttctctcgcctaccattccgtagggaaacaacgctcgccctcaccagtccgacggggccaggcaacgacgatagaatgtatattactctacgttcgtcgtttccgtttaggtggtgggggtccgtggtacgttaggttttggggtcggtttccgggcggggtaacgggtaaacccaacggtccgacccgttaccgttacggccgcggaccccgaaggtcccgtcccgtcccccgtcggttaccctcgttcccttccccg

SEQ ID NO: 362540 - DNA, 552 bp, Homo sapiens
  misc_feature: GZ8MTXP01BGFZV.15.34.D01.1.454.CMB.2.raw
  modified_base (397)..(397): a, c, t, g, unknown or other
  modified_base (432)..(432): a, c, t, g, unknown or other
  modified_base (481)..(481): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacactcgctcgttcccgggtccctgactcccgcttctcgtggacctccattcccgttgggaaaccaaagcctacgccctcaccntcgacggggcccaggcagacgatgaatgtgattancacgtgtcgttccttagtggtgggcgtggctagtttggggtgttcgggnggaacgggaccaaacgtcgaccgtctagttccgcgcccgaaggcctcgcccctggctaaccgttcttcccg

SEQ ID NO: 362541 - DNA, 584 bp, Homo sapiens
  misc_feature: GZ8MTXP01BM7SO.15.34.D01.1.454.CMB.2.raw
  modified_base (320)..(320): a, c, t, g, unknown or other
  modified_base (425)..(425): a, c, t, g, unknown or other
  modified_base (450)..(450): a, c, t, g, unknown or other
tcagtctacgtagccacgaccggtgctcgatttagatcgtctgtgttggggttgggaagcctgagaacacttagccttcatgagtgccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgcctggtacccggcacgaccccaggccacgccctccacgcacgctcatctacagtaacaaacnctcgctcgttccgggtcctgactccgcttctcgtggcctaccactccgttagggaaacaaagcctcgccctacacactcgaccggggccaggcagacgatgatgngtattatcacgtgtcgttcgttagnggtgggtacgtggtcgtaggtttggggtggttcggggcgggaacggtaaccaaacggtcgaccgtaccgtagggttccacggcccgtaaggcccgtccgtcccccgtcgggttccctaaccgttccgttccccg

SEQ ID NO: 362542 - DNA, 627 bp, Homo sapiens
  misc_feature: GZ8MTXP01BFDUH.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactcgccgctggtaccgcacgaccccaggccacgcctccacgcacgctcatctacagtacaacactcgctcgttccgggtcctgactcccgtcttctcgtcgcctccctacttcccgttagggaaacaaacggcctcgacccctcaacccacgtacggacccgggggcccagggccaaggtaccgatagtaagtgtagtattaactcacgtcgtcggtttcctttagtgggtcgggtcgtggtagttaggtttgggggtcgttcggggacggaacgggaacccttaaacggtcgacccgtaccgtaggttaccgcggaccccgaacgggccctccggtcccccgtccgggttacctaacccgttcgttccccg

SEQ ID NO: 362543 - DNA, 576 bp, Homo sapiens
  misc_feature: GZ8MTXP01CABUU.15.34.D01.1.454.CMB.2.raw
  modified_base (319)..(319): a, c, t, g, unknown or other
  modified_base (436)..(436): a, c, t, g, unknown or other
  modified_base (495)..(495): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctctagtctctacttctaactaccgccgcctggtaccggcacgaccccaggccagccctccacgcacgctcatctacagtacaaacnctcgctccgttccggggtccctgactcccgcttctcgtcgcctccattccgtagggaaacaaaggctcgcccctcacccactcgaccggggcccaggcagacgatgaatgtgattancacggtgtaccgttcctttagtggtcgggcgttggtcgtagtttggggtgttccggggnggtaacgggaccaaacgtcgttacccgtacgtacgttcgacgcccgaagcctccgcccctggttccaaccgttcttccccg

SEQ ID NO: 362544 - DNA, 556 bp, Homo sapiens
  misc_feature: GZ8MTXP01AVXM2.15.34.D01.1.454.CMB.2.raw
  modified_base (320)..(320): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctcgttccggggtccctgactccgcttctctgcctccatccgttagggaaactaaacgctcgccctcaccatccgaccggggcccaggcagacgatagaatgtagtattatcacgtcgtcgttcctttagtggtggggtcgtggcgtgttgggtggttcgggcggaacgggtacaaacgtcgaccgtcgtaggttcgcgcccgaagcctccgcccctcggctcttcgtcccg

SEQ ID NO: 362545 - DNA, 580 bp, Homo sapiens
  misc_feature: GZ8MTXP01B8F8A.15.34.D01.1.454.CMB.2.raw
  modified_base (313)..(313): a, c, t, g, unknown or other
  modified_base (343)..(343): a, c, t, g, unknown or other
  modified_base (421)..(421): a, c, t, g, unknown or other
  modified_base (427)..(427): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttggaggtctggctcagtctctacttcaactcgccgctggaccgcacgacccaggccacgcctccacgcacgctacatctaacagtacaacnctcgctcgtccgggtcctgactccgcttcncgtcgctccatccgtaggaaacaagctacgccctacacccagtccgaccggggcccaggacctagacgatagaatggntattanctacgtcgtcgttcttagtggtgggtcgtggtcgtagtttggggtacgtcgggcggtaacgggaccttaaacgtcggttacccgtccgtacggcgcggaccccgaagggtccctcccggtcccccgtcggttacctcccgttccgttccccgg

SEQ ID NO: 362546 - DNA, 701 bp, Homo sapiens
  misc_feature: GZ8MTXP01CBXFF.15.34.D01.1.454.CMB.2.raw
  modified_base (265)..(265): a, c, t, g, unknown or other
  modified_base (353)..(353): a, c, t, g, unknown or other
  modified_base (490)..(490): a, c, t, g, unknown or other
  modified_base (498)..(498): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagggtgaggtgcaggtggtggaatcgtgggggagcttggtccagccgtgggggtccctgacgactctcctgtgcagcctntggattcagttctaagtaaatacgtggataaggttgggtccgccgaggctccgagggggaagggctgggaggtggatggaccaaagtntaggaaccaaagacggaagtagaataaacatcatgggtcgggctcgtgtgcgacggggcctattcacttactcctaccgaagaacgaccaaacggccaaagtactcgtagttattaattacgataaaagtcgaaacncggtaccnggaacgcggaccccgaacgaaccgtacgggtcttagggtaacgtttaacttaccgggtgggttcgggggaaccggggggtacgggggttacccgggggttaagggggtttcgggttttaagggttttaggggtaaacctttttaccggggtttttacggggccggggggggtaaccccggttaacggggggttaacccccccg

SEQ ID NO: 362547 - DNA, 674 bp, Homo sapiens
  misc_feature: GZ8MTXP01AYCNB.15.34.D01.1.454.CMB.2.raw
  modified_base (305)..(305): a, c, t, g, unknown or other
  modified_base (329)..(329): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactctacttgtgccttggaggtctggctcacgtctcttacttctaactaccgccgctggtacccgcacgaccccaggccacgccctccgacncacgctcatcaacacgtacaaacnctcgtctcgttccgggtcctgctccgtcttctcgtcggcctaccatcccgtaagggaaactaacggctcgacccctacacccacgtcccggaccgggggacccagggaccaaggtaaccgagttaggaaattggtaagttaacttacgtaccgtaacgggttcgttaccggtttccgtttaagggtcggttcgggggtccgttggtacgttagggtttcggggtccgttccggggacgggtaacgggtaaccttacggtaccggttacccgtaccggtacggttaccgcggacccgtaacggcccctccggtcccccgtcggttacctcccgttccgttcccccg

SEQ ID NO: 362548 - DNA, 716 bp, Homo sapiens
  misc_feature: GZ8MTXP01AIZY0.15.34.D01.1.454.CMB.2.raw
  modified_base (304)..(304): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggagcttggtccaggccgtgggggtccctgagactctcctgtgcagcctctggattcagttctagtaaatcgtggataaggttgggtccnccgaggctccgaggggaagggctgggagtggagtcggacccaaagtagtacgaaacccgaaaggaaccggggaaagttaggaaattaaaacgattacgaagttgggtcggggcttacgtgggtcggaccgagggggtcccgtatttccacttatcctaccgagtacgaaccaaacggcctaaagaacttacgttagtacgttaatttagaaccgtaaaattacggaaactacggtaccgtaggaacgaacggaccccgaaacggacccgtaacgggtccttgggtaagttaacgtttacggtggttggggaccgggggtaggggttcccggggttagggttacgggtttaagtttgggtaacgtttaccggtttcgggttcgggggtaacccgttaaccgggggtaaccccg

SEQ ID NO: 362549 - DNA, 649 bp, Homo sapiens
  misc_feature: GZ8MTXP01DPLRS.15.34.D01.1.454.CMB.2.raw
  modified_base (316)..(316): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactcgccgcctggtaccggcacgaccccaggccagccctccacgcacgctcatctaacagtacaaacnctcgcttcgttcccgggtcctgactccgcttctctgctccatccgtagggaaacaaagctcgccctacacccactccgaccgggggcccaggcaagtaacgatagaatgtacgtattactcctaacggttcgtaccgtttacctttaggtcgggttcgggggtccgttgggtaccgtttgggtttcgggggttcggtttccgggggacggggtaacgggtaacccgttaaacggtccggttaacccggttacccgtagggttacccgacggacccgtaacgggtcccgtcccggtcccccgtcggttaccctaaccgtttcccgtttccccgg

SEQ ID NO: 362550 - DNA, 564 bp, Homo sapiens
  misc_feature: GZ8MTXP01BKDFZ.15.34.D01.1.454.CMB.2.raw
  modified_base (351)..(351): a, c, t, g, unknown or other
  modified_base (425)..(425): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggcccacgccctccacgcacgctcatcacagtacaaacactcgctccgttccggggtccctgactccgcttnctggctccatcctagggaaacaagctcgcccttacatccgacgggggcccaggcagacgatgaatgtagattanctactgcgttcttagtgggtggggcgttggcgtaggtttcggggtggttccgggcggaacgggaaccgaaacgttcgaccgttccgtaggtcacggcccttaggcctccgccccgtggccacgtccgttccggttcccc

SEQ ID NO: 362551 - DNA, 548 bp, Homo sapiens
  misc_feature: GZ8MTXP01AKI9J.15.34.D01.1.454.CMB.2.raw
  modified_base (461)..(461): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactaccgccgcctggtacccggcacgacccccaggccacgccctccacgcacgctcatctacagtacaaacctcgcctcgttccgggcctgatccgcttctctgctccactccttagggaaacaaagctgccctacgaccactccgacgggggcccagggacagacgatggaatgtgtatatcacgtgtcgttccttagtggtgggcgtggtntagttgggttggtcgggcgggaaggaccgaaacgtcgaccgtctaggttccagccaaggctcggcccctcggttctccttcgtcccg

SEQ ID NO: 362552 - DNA, 586 bp, Homo sapiens
  misc_feature: GZ8MTXP01BSECB.15.34.D01.1.454.CMB.2.raw
  modified_base (317)..(317): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactacgccgctcggtaccggcacgaccccaggccacgcctccacgcacgctcatctacagtacaacnctcgctcgttccgggcctgactccgcttctctcgctaccatccgtagggaaacaagctcgcccctcaccacgtccgaccggggccaggcaagacgatagaagtgtagtatactcacgtcgtcgttccttagtggtgggtcgtggtcgttggtttggggtcggttcgggcgggtaacgggtaaccgttaaacgtcgacccgttccgtaacggttccgacgacccgaacggcctccgtccccgtcggttcctaaccgttccgttaaccccg

SEQ ID NO: 362553 - DNA, 561 bp, Homo sapiens
  misc_feature: GZ8MTXP01EMYPM.15.34.D01.1.454.CMB.2.raw
  modified_base (384)..(384): a, c, t, g, unknown or other
  modified_base (405)..(405): a, c, t, g, unknown or other
  modified_base (411)..(411): a, c, t, g, unknown or other
  modified_base (438)..(438): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcagaccccaggccagccctccacgcacgctcatctacagtacaaacactcgctcgttccgggtcctgactccgcttctctggctccatcccttgggaaacaaagctcgccctcaccntcgacggggccaggcagacgntagaangtgattatcacgtgtcgttcctttagnggtggggtcgtggtcgtagtttggggtcgttcgggcgggaacgggaccaaacgtcgttacccggtcgtacggttcgcgcccgaaggccgtccgtcccccgcggttacctcccgttcgtccccg

SEQ ID NO: 362554 - DNA, 770 bp, Homo sapiens
  misc_feature: GZ8MTXP01A9FC1.15.34.D01.1.454.CMB.2.raw
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccgagggtgaggtgcgaggtggtggaagtcggtgggggagcgttggtccaggtccggtgggggtccctggacgtactctcctgtgcacgtcctcgtggtattcgagttctaagtaaatcgtaggattaaggttcgggtcccgccgaaggtcctaccggagggggaacgggctgggaggtggagtggacccaatacgtacgaaaccgaaggaacggtaagtacgaaataaacagtacgagttgggtcgggtcttcgtggtgccggacggggtaccgtatttaccgacttatacccgtaccgaaggaacgaacccgaaaccgtacccgtaaagtaacgttacgttaagttaggttttaaactttacgggaaacgttaaaacgttacggggtaaacccaacgggttacccgttaggaaaccggacggtaccccggaaacggaaccggtaccgggtaccttgggttaagttaaacgttttccgggaggttcgggggaccgggggtacgggttacccgggttggttgggtttaagtttacgggtcgtttaccggtttcgggcgggggtaacccgttcgggggttaaccccg

SEQ ID NO: 362555 - DNA, 541 bp, Homo sapiens
  misc_feature: GZ8MTXP01ERJE3.15.34.D01.1.454.CMB.2.raw
  modified_base (315)..(315): a, c, t, g, unknown or other
  modified_base (334)..(334): a, c, t, g, unknown or other
  modified_base (346)..(346): a, c, t, g, unknown or other
  modified_base (412)..(412): a, c, t, g, unknown or other
tcagtctacgtagccacgaccggtgctcgatttagatcgtctgtgttgggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacnctcgctcgttccgggtccngatcccgcttcncgtgctccatccttagggaaacaagctcgccctcaccatcgacggggccaggcagacgatgaatgngattatcacgttgcgtttcctttagtggtggggcgttggcgtagtttggggtgtttcggggcggtaagggaccaaacgtgaccgtcgttacggcacgccaaggctccgcccctggacctcttcgtcccg

SEQ ID NO: 362556 - DNA, 627 bp, Homo sapiens
  misc_feature: GZ8MTXP01B15VN.15.34.D01.1.454.CMB.2.raw
  modified_base (404)..(404): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgagtctggctcagtctctacttactaactacgccgtctggtaccgcacgaccccaggccagcctccacgcacgctcatcacagtacaacactcgctcgttcccgggtcctgactcccgcttctcgtcggcctacccattcccgttaaggggaaaccaaagtcctcgcccctcaccncgtccgaccgggggccaggcagacgagtagtaagtcgtagtattatcctacgttcgtcgtttacctttaggtgggtcgggtcgtggtacgttaggtttggggtcggttccggggcgggtaacgggtaaccaaacggttccggaccgttccggtaaggttcccgacggaccccgtaaggcccgtcccggtccccgtcggttccctaaccgttcgtttcccccgg

SEQ ID NO: 362557 - DNA, 670 bp, Homo sapiens
  misc_feature: GZ8MTXP01ENZBB.15.34.D01.1.454.CMB.2.raw
  modified_base (327)..(327): a, c, t, g, unknown or other
  modified_base (451)..(451): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgtccttgaggtctggctcagtctctacttctaactaccgccgccgtggtacccggcacgacccccaggccacgccctccacgcacgctcatcacagtaacaaacnctcgctccgttcccgggcctgactccgtcttctcgtcgcctacctattccgtagggaaacaaacgcctcgccctacaccacgtccggaaccggggcccaagggctaaggacgatagaatggtanattacgctacgttcgtcgtttccttaggttgggtcgggggtcttggtcgttaggtttcgggggttacggttccgggggacgggtaacgggtaaaccccgttaaacgttccggttacccgttaccggttaacggggcccaccggaccccggtaaaccggggtcccttccccggtcccccggttacgggttcccctaacccggtttcccgtttcccccggg

SEQ ID NO: 362558 - DNA, 678 bp, Homo sapiens
  misc_feature: GZ8MTXP01BUI2K.15.34.D01.1.454.CMB.2.raw
  modified_base (504)..(504): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctgctcagttctctacttactaactaccgccgccgtcggtaccgcacgaccccaggccacgccctaccacgccacgctcatacctacaagtaaccaaactacctcgtccgttccgttcccgggggtccctgtacttccccgtctttctcgtcggtccttaacccgattcccggttaggggaaaacctaaacggcccttacggaccccctacgaacccacgtcccggaaccgggggcccagggacaacgaacgatagaatgtagtaacttacncgtacgttcggtccgtttcgtttaggcgggtggggcgttggcgtttaggtttcggggtcggttcggggacgggaacgggtaaccaaacggttcccggaccgttccgtaagggttcccgacgacccgaaggtccctcccggtcccccgtcggttacctccgtttcccgttccccg

SEQ ID NO: 362559 - DNA, 548 bp, Homo sapiens
  misc_feature: GZ8MTXP01EKBJH.15.34.D01.1.454.CMB.2.raw
  modified_base (439)..(439): a, c, t, g, unknown or other
  modified_base (471)..(471): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacactcgctcttccgggtcctgactccgcttctctgctccattccgttagggaaacaaagctacgccctcaccatcgacggggcccaggcagacgatgaatgtgattatcacgtgtcgttcctttagnggtgggcgtggtactgtttggggtgttcgggngggaacggaccaaacgtgaccgtcgtaagttccgacgcccgaaggcctcgcccccgtggttcctccgttccgtcccg

SEQ ID NO: 362560 - DNA, 594 bp, Homo sapiens
  misc_feature: GZ8MTXP01CVRS1.15.34.D01.1.454.CMB.2.raw
  modified_base (354)..(354): a, c, t, g, unknown or other
  modified_base (435)..(435): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcagggagtggattctcagactgtggtgacccaggagccatcgttctcagtcgtcccctggagggacagtcacactcacttgtgccttgaggtctggctcagtctctacttctaactaccgccgcctggtaccgcacgaccccaggcccagccctccacgcacgctcatcgtacagtacaacactcgctcttccgggtcctgactccgtcttcnctcggacctccctatccgttagggaaacaaacgtctcgccctacaccactcgaccggggccaggcagacgatgaagtgtanattatacacgttgtccgtttccgtttagtgggtggggcggttggtacgttgtttggggtgttcgggcggaacgggaaccaaacgtcgaccgtaccgtcggttcgcggccctaacgggcctcccggcccccgtccgggttcctaaccgttccgttccccg

SEQ ID NO: 362561 - DNA, 577 bp, Homo sapiens
  misc_feature: GZ8MTXP01AWG06.15.34.D01.1.454.CMB.2.raw
  modified_base (319)..(319): a, c, t, g, unknown or other
  modified_base (540)..(540): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctcgttccgggtcctgactccgcttctctggctccatccgtagggaacaaagctcgccctcaccactcgaccggggccaggcagacgatgaatgtgtattatcacgtcgtcgttcctttagtgggtgggcgtggtcgtagtttggggtggttcgggcgggaacgggaaccaaacgtcggttaccgtccgtacggttcgacggccccgaacggtcccnccgtcccccgtcggttacctaaccgttccgttccccg

SEQ ID NO: 362562 - DNA, 563 bp, Homo sapiens
  misc_feature: GZ8MTXP01EQSHZ.15.34.D01.1.454.CMB.2.raw
  modified_base (320)..(320): a, c, t, g, unknown or other
  modified_base (391)..(391): a, c, t, g, unknown or other
  modified_base (428)..(428): a, c, t, g, unknown or other
  modified_base (434)..(434): a, c, t, g, unknown or other
  modified_base (486)..(486): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacagtcacactcacttgtgccttgaggtctggctcagtctctacttctaactacgccgctcggtaccggcacgaccccaggccacgcctccacgcacgctcatctacagtacaaacnctcgctcgttccgggtcctgactccgcttctctcggctaccattcccgtagggaaacaaaggctcgccctnacccagtcgacgggggcccaggcagacgatggaatgnattacncacgtgtcgttcttagtgggtgggcgtggcgttggtttgggtcggttcgggngggaacggtaccaaagtcgaccgtcgtaggcgacgcccgaagggcctccgtccccgtgttctaaccttcgttccccg

SEQ ID NO: 362563 - DNA, 662 bp, Homo sapiens
  misc_feature: GZ8MTXP01CVHPN.15.34.D01.1.454.CMB.2.raw
  modified_base (260)..(260): a, c, t, g, unknown or other
  modified_base (277)..(277): a, c, t, g, unknown or other
  modified_base (619)..(619): a, c, t, g, unknown or other
  modified_base (650)..(650): a, c, t, g, unknown or other
  modified_base (652)..(652): a, c, t, g, unknown or other
  modified_base (654)..(662): a, c, t, g, unknown or other
tcagtctacgtagccacgaccggtgctcgatttagatcgtctgtgttgggtttggggtccctgagactctcctgtgcagcctctggattcagttctaagtaaatactggataagttgggtccgccaggctccaggggaagggctggagtggatggccaatatgaaaccaagacggaagtgaataaaacatcatggtgggctctgtgcgagggcctattcactatcctccaagagaaccaacgaccaaagaattctagttntatttgacaaatgaacngcctagagacgccgaacgacgacggcttgtagttattacgtggtgggaccgggggaggggccgtaggttggttaagttttcggaactttacgtttcgggcgggggaccgacgggggtcccttggtcccccacccggttctccgtccgaccgtcccctaccgaacccggaaccgggtcccctaggttcccggtcccccttcccccggtgggccccgtcccgtacgtcctaccggacggaccgaccgacccgtaccggacgacgccaccgacggccgggtcccgtgggggtccgtcgtccgtacgggacaaacggtcctaccgttccgacgtacgtaacgtcgngggaacggcgggcgtacggcggagcgttagngngnnnnnnnnn

SEQ ID NO: 362564 - DNA, 580 bp, Homo sapiens
  misc_feature: GZ8MTXP01DY8H2.15.34.D01.1.454.CMB.2.raw
  modified_base (320)..(320): a, c, t, g, unknown or other
  modified_base (433)..(433): a, c, t, g, unknown or other
  modified_base (439)..(439): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactacgccgcctggtaccgcacgaccccaggcccagccctccacgcacgctcatctaacagtaacaaacnctcgctcgttccgggcctgactccgcttctcgtcggcctacccattccgttagggaaacaaagtcctcgccctcaccacgtcgaccggggcccaggcagacgatagaatgtanaattancgtacgtgtcgttcctttagtggtggggcgttggtcgttaggtttggggtcggttcgggcggtaagggaaccaaacgtcgaccgtcgtagttcgacgccgaaggtcctccggcccctcggttcctaaccgttccgtccccg

SEQ ID NO: 362565 - DNA, 632 bp, Homo sapiens
  misc_feature: GZ8MTXP01CSD66.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgtccttgaggtctggctcagtctctacttctaactacgccgccgtggtaccggcacgaccccagccacgcctccacgcacgctcatcacagtacaaacactcgctcgttccgggtcctgactcccgcttctcgtcgcctaccacgttccgttagggaaacaaacgtcctacgcccctacacccacgtccggacccgggggacccagggaccaaggacgagtacgaattgagtattactctacgtcgttccgtttccttaggtggttcggggcggttggtacttgggttttcggggtgggttccgggcggggaacgggaacccgttaaacgtcggacccgttcgtacggacgccggacccgaacgggccctccgtcccccgtggttccctaaccgttccgtttaaccccg

SEQ ID NO: 362566 - DNA, 560 bp, Homo sapiens
  misc_feature: GZ8MTXP01AU62B.15.34.D01.1.454.CMB.2.raw
  modified_base (289)..(289): a, c, t, g, unknown or other
  modified_base (316)..(316): a, c, t, g, unknown or other
  modified_base (480)..(480): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctcggaccgcacgaccccaggccagccnccacgcacgctcatctacagtacaacnctcgctcgttccgggtcctgactcccgtcttctctcggcctccattccgttagggaaacaaagtctcgcccctcacacgtcgacgggccaggccagacgatagatgtagattatcacgtcgtcgttcctttagtggtgggcgtgtcgtgttcgggtgtccgggnggtaacggacaaacgtcgaccggtcctaggttccgcgacccgaagcccgtcgccccgtcggcctaaccgttcgttccccg

SEQ ID NO: 362567 - DNA, 745 bp, Homo sapiens
  misc_feature: GZ8MTXP01DJKQV.15.34.D01.1.454.CMB.2.raw
  modified_base (239)..(239): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactggtggtgacccaggagccattcgttctcagtcgtcccgtggagggacagtcacactcacttgtcgccttggaggtctggctnagtctacttacttacaactacgccgcgtcggtaccggcacgacccagccagcctccacgcacgctcatctaacaagtaacaaacactcgccttccgttcccgggggtccctgacgttccccgtctttcgtcgttcggcccttaacccaacgtttcccgttaaggggaaaacaaacgggtccttaccgccccctacaaccccgtaacgtcccgggaaccggggggccccaagggaccaaggtaaaccggtattaggaaactggtagtaaattactacctaacggtcggttaccgtttaccgttttaaggtcgggggtgggggtaccgttaggtccgtttaaggtttcggggggttcgggttccgggggaaaccggggtaacgggaaaaccccgttaaaacggttcccgggttacccgtacggttccgggttacgaacccgaccccggtaaacgggccccgtccccgtcccccgggttcggttaccctaaccctttcggttccccccg

SEQ ID NO: 362568 - DNA, 641 bp, Homo sapiens
  misc_feature: GZ8MTXP01ETI4B.15.34.D01.1.454.CMB.2.raw
  modified_base (322)..(322): a, c, t, g, unknown or other
  modified_base (391)..(391): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactaccgccgcctggtacccggcacgaccccaggccagccctccacgcacgctcatctacagtacaaacnctcgctcgttccgggcctgctccgcttctcgtgctccatccgtagggaaacaaacgctcgccctcaccncgtcgaccggggccaggcagacgatagaagtgtagtattaatccgtacggtcgtccgtttccgtttagtggggttcgggggcggttgggtacgttagggttttcgggggttggtttcggggacggggtaacggggtaacccgaaacggtcggacccgttaccggtaacgggttaccgcggttaccccggaacggtcccgtaacccggtccccccggtcgggttaccctaaccgttccgtttaaccccggg

SEQ ID NO: 362569 - DNA, 611 bp, Homo sapiens
  misc_feature: GZ8MTXP01DYMN4.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgtccttgaggtctggctcagtctctacttctaactacgccgcctggtaccgcacgaccccaggccagccctccacgcacgctcatctaacagtacaaacactcgcttccgtccggggtcctgactccgtcttctcgtcggcctacccatcccgtagggaaacaaagcctcgccctcaccagtccgaccggggccaggcagacgatagaatgtagtattacgtctacgtgtcgttccgtttagtgggtgggtcggtggtacgttggttttgggggtcggttcgggcggggaacgggtaaccaaacggtcgacccggtctacggggttcacggcccgtaacgggtccctccggtccccccgtgggttaccctaaccttccgtttaaccccg

SEQ ID NO: 362570 - DNA, 645 bp, Homo sapiens
  misc_feature: GZ8MTXP01BJKFA.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactcgccgcctggtaccggcacgaccccaggccagccctccacgcacgctcatctacagtacaaacactcgctcgttccggggtcctgactccgcttctctgcctccatccgttgggaaaccaaagcctacgcccctacacccagtccgaccgggggccccagggccaaggaaccgagtagtaaagtgtagtattaacgtcctaacgtcgtaccggttcccttttagtgggtcgggggtcgtacgggtcgttaaggtttgggggtcggtttccggggcgggtaacggggtaaccgaaaccgtcggacccggttacgtacggggttacgaccgaccccggtaacgggcccgtcccggtccccccggttcgggttccctccgtttcccgtttaaccccg

SEQ ID NO: 362571 - DNA, 564 bp, Homo sapiens
  misc_feature: GZ8MTXP01DYC7V.15.34.D01.1.454.CMB.2.raw
  modified_base (315)..(315): a, c, t, g, unknown or other
  modified_base (456)..(456): a, c, t, g, unknown or other
  modified_base (482)..(482): a, c, t, g, unknown or other
  modified_base (489)..(489): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgctggtaccggcacgaccccaggccagccctccacgcacgctcatcacagtacaaacnctcgctcgttcccgggtccctgactccgcttctcgtcggcctaccattccgtagggaaacaaacgctacgccctcaccatcgacggggcccaggcctagacgatagaatgtagattactcgacgttgtccgtttctttagngggtgggtcgtggtactggtttgggngtccggngggaacgacaaacgtcgaccgtcgtacgcgcgaccaaggctccggccccgtggcctaaccgttcccgttaacccg

SEQ ID NO: 362572 - DNA, 557 bp, Homo sapiens
  misc_feature: GZ8MTXP01B01KQ.15.34.D01.1.454.CMB.2.raw
  modified_base (402)..(402): a, c, t, g, unknown or other
  modified_base (412)..(412): a, c, t, g, unknown or other
tcagtctacgtagccacgaccggtgctcgatttagatcgtctgtgttggggttgggaagcctgagaacacttagccttcatgagtgtcccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttcaactacgccgcctggtaccggcacgaccccacggccacgcctccacgcaccgcctcatcacagtacaacactcgctcttcccgggcctgactccgtcttctctcggctacccatccgttgggaaacaagctacgccctcacactcgaccggggccnggcagacganagaatgtgattatcacgtgtcgttcttagtggtgggcgtggctagtttggggtcgttcggcgggtaacggaacgaacgtcgaccgtcgtagttccgagacccgaaggccctcgtccccctggttcctaaccgttccgttccccgg

SEQ ID NO: 362573 - DNA, 615 bp, Homo sapiens
  misc_feature: GZ8MTXP01D4SJD.15.34.D01.1.454.CMB.2.raw
  modified_base (325)..(325): a, c, t, g, unknown or other
  modified_base (509)..(509): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcactttgtcgccttggaggtctggctcagtctctacttctaactacgccgcctggtaccggcacgaccccaggccacgccctccacgcacgctcatcacataacaaacnctcgccttcgttcccggggtcctgactcccgcttctctcggcctaccacttccgtagggaaacaaacgctcgcccctcaccagtccggaccggggccaggcagacgagtagaatgagtaattatcacgttcgtccgtttcctttagtgggtgggtgtggtacgttggtttggggtggtccgggngggtaaacggaccgaaacgtcggttacccgtcgtacggttaccgaccgttacccgaacggtccctcccgtccccgtcggttccctaaccgttccgtttaacccccg

SEQ ID NO: 362574 - DNA, 759 bp, Homo sapiens
  misc_feature: GZ8MTXP01DURC0.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtccccgtggagggacagtcacactcacttgtgccttgagtctggctctagtctctacttctaactacgccgcgtggtaccggcacgacccccaggcccacgccctaccgacgccaccgctcatcctaacaagttaaccaaaccaccttccgtccgtttcccggtttcccgggggtaccctggtaccttccccgtctttctcgtacggccttacccgtattcccggttaaaggggaaaaccaaacgggtcccttacccggacccccttcgaaacccgtacgttacccggacccggggggaccccacgggtaccgaaggtaaacccgtagtaacgtaaacgtcgtagtaaactttatacccgtacgttcggtaccgtttccgtttaagttcggggtcggggtccgttgggtaaccgtttgggtttttcgggggtacggttttccggggaagggtaaccggggtaaacccttaaacggtcccggttaccgtacccgtaaggttcccggacgaccccggtaacgggtcccttaacccgggtccccctcggttacctccctttcccggtttcccccg

SEQ ID NO: 362575 - DNA, 606 bp, Homo sapiens
  misc_feature: GZ8MTXP01AR3Q6.15.34.D01.1.454.CMB.2.raw
  modified_base (186)..(186): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttcncagtcgtcccctggagggacagtcacactcacttgtgccttgaggtctggctcagtctctacttctaactacgccgcctggtaccggcacgaccccaggccacgccctccacgcacgctcatctacagtacaaacactcgcctcgttccgggtccctgactcccgcttctcgtcggcctccattccgttagggaaaccaaaggctcgccctacaccacgtcgaaccgggggcccagggcagacgatagaatgttagtattactcacgtgcgtttcctttagtgggtcgggtcggtggtcgtaggtttcggggtggttccggggacggtaacggggaaccaaacggtcgacccgtcgttaacggccgacgacccgaacggcctcccggtcccccgtcggttcctaacccttccgttccccg

SEQ ID NO: 362576 - DNA, 591 bp, Homo sapiens
  misc_feature: GZ8MTXP01DOGZ1.15.34.D01.1.454.CMB.2.raw
  modified_base (451)..(451): a, c, t, g, unknown or other
  modified_base (457)..(457): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccattcgttctcagtcgtccctggagggacagtcacactcacttgtgccttgaggtctggctcagtctactactttacaactacgccgcctggtaccggcacgaccccaggccacgccctccacgccacgctacactcctaacacgtaacaaacacctcgcttccgttcccggggtcctgactccgtcctttctcgtcgcctacctacttcgtagggaaacaaacgtcctacgccctcaccacgtccggaccggggcccaggcagacgatgaatggtanattacnctcgtcgttcgttcctttggtcggtggggtcgtggtcgttggtttggggtacgttcgggacgggaacgacgttaacgtcgaccgtcgtcggacgcgaccgaagtcctccgaccctggttcctcgttccttcccg

SEQ ID NO: 362577 - DNA, 643 bp, Homo sapiens
  misc_feature: GZ8MTXP01DX53H.15.34.D01.1.454.CMB.2.raw
  modified_base (284)..(284): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtgtccttgaggtctggctcagtctctacttctaactacgccgcgtggtaccggcacgaccccnggccagccctccacgcacgctcatctaacatacaaactctcgccttcgttcccgggtcctgactccgcttctcgtgcctacccattccgtagggaaacaaagcctcgccctcacccacgtccggaccggggcccagggacgaacgacgagtagtaagtgtagtattactctacgttcgtccgtttaccgtttaggtgggtcggggtcggttggtcggttaggttttcgggggttacgggttccggggacggggtaaacgggaaacgttaaaccggtcggttacccggttacgtacggttaccgaccgcccgaacggtcccgtaaccgtcccccgtcggttaccctccgttccttccccg

SEQ ID NO: 362578 - DNA, 615 bp, Homo sapiens
  misc_feature: GZ8MTXP01BWBBL.15.34.D01.1.454.CMB.2.raw
  modified_base (421)..(421): a, c, t, g, unknown or other
  modified_base (473)..(473): a, c, t, g, unknown or other
  modified_base (479)..(479): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggaggacagtcacactctacttgtcgtcttggaggtctggctcagtcttcttacttactaactaccgccgtcgtcggtacccgcaaccggaccccgaggccacgccctccgacgcaccgctcactcacaagtaacaaacctcctccgtccttccggttccccggggtcctggtactccccgtcttctcgtcgacctccacttccgtaagggaaacaagtccgtacnccctacaaccgtacgccgggaccggggacccagggcaagacgatagaatgtntattanctacgtcgtcgttacttgtgggtcgggtcgtaggtcgttggttgggtggtccggggcggaacgggaaccaaacggtcgaccgtccgtaggttccgacgccgaacggccgtccgccccgtggcctcttccgttcccg

SEQ ID NO: 362579 - DNA, 891 bp, Homo sapiens
  misc_feature: GZ8MTXP01B514X.15.34.D01.1.454.CMB.2.raw
  modified_base (282)..(282): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtgtccttggaggtctggctcagtctctacttctaactaccgccgctcggtaccgcacgaccccgnggccacgcctccacgcacgctcactcacacgtacaaacactcgtccttccgttcccgggtccctgtactccccgtctttcgtcgtcggtcctacctacgtcccgttaggggaaacctaaacgtcccgtaccgtacccccttacgaacccgtaaccggttacccggggaaccccgggggggaccccgaacgggggtacccggaaacgggtaaacccgggtaaacggtttaacgggtaaaacgtttcggggttaaagtttaacggtttaactttaccccggtaccggtttaaccggggttaccccgtttttccccggttttaaggggtttcgggggttacgggggggttcgggtttccgggggttaaacgggttttacgggggttttttcggggggggttacccggggtttttaccggggggaacccgggggtaaaccgggggttaaaccccgttaaaaccggggtttacccgggttacccggttaaccccggggtaaccggggtttaccccgacccgggttaaccccgggtaaacgggtcccccgtttccccgggtcccccccggttacgggttacccctccccggttttaaccccggtttcccccccgg

SEQ ID NO: 362580 - DNA, 585 bp, Homo sapiens
  misc_feature: GZ8MTXP01E0MSY.15.34.D01.1.454.CMB.2.raw
  modified_base (281)..(281): a, c, t, g, unknown or other
  modified_base (320)..(320): a, c, t, g, unknown or other
  modified_base (432)..(432): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgcctggtacccggcacgaccccnggcccagccctccacgcacgctcatctacagtacaaacnctcgcctcgttccgggcctgactcccgcttctcgtgcctccattccgttagggaaacaagctcgccctcaccagccgaccggggccaggcagacgatagaagtgtagattanactacgtcgtcgtttcctttagtgggtcggggtcgtggtcgttaggtttgggtcggttcgggacgggaacggaaccgttaaacgtcggaccgtcgtacggttccgcgacccgaaggcccgtccgtccccgtcgttcctccgttccgttccccg

SEQ ID NO: 362581 - DNA, 570 bp, Homo sapiens
  misc_feature: GZ8MTXP01DHPB4.15.34.D01.1.454.CMB.2.raw
  modified_base (313)..(313): a, c, t, g, unknown or other
  modified_base (345)..(345): a, c, t, g, unknown or other
  modified_base (396)..(396): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgctggtaccgcacgaccccaggccagccctccacgcacgctcatcacagtacaacnctcgctcgttccgggtcctgactcccgcttcncgtacgcctaccctatcccgttagggaaaccaaagtcctcgccctcgaccncgtacggaccgggggcccaggcaagacgatgaatgtagtattatcacgttcgcgtttcgttagtggtgggcgtgtcgttgttgggtcgtcgggacggaacggtaccaagtcgaaccgtcgtcggacgcgttacccgaaggtcctcgtccccgtcggttcctcgttcgttccccg

SEQ ID NO: 362582 - DNA, 595 bp, Homo sapiens
  misc_feature: GZ8MTXP01D163U.15.34.D01.1.454.CMB.2.raw
  modified_base (323)..(323): a, c, t, g, unknown or other
  modified_base (339)..(339): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactggtggtgacccaggagccatcgttctcagtcgtcccctggagggacagtcacactcacttgtgccttgaggtctggctcagttctctacttactaactacgccgcgtggtaccgcacgaccccaggccagccctccacgcacgctcatctacagtacaaacactcncctcgttccgggtccngactccgcttctcgtcgcctacccattcccgtagggaaacaaacgcctcgccctcaccactcggaccggggcccaggactagacgtatagatgtgattatcacgtgtccgttactttagtgggtggggcgttggtcgtagtttggggtcgttcggggacgggtaagggaacccttaaacgtcgacccggtacgtacgggttacgcgacccgtaaggccctccggccccgtcggttcctaacgttccgttaaccccg

SEQ ID NO: 362583 - DNA, 622 bp, Homo sapiens
  misc_feature: GZ8MTXP01AIYPJ.15.34.D01.1.454.CMB.2.raw
  modified_base (321)..(321): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggccacgccctccacgcacgctcatcacagtacaacnctcgctcgttccgggtcctgactcccgcttctctcggcctaccacttccgttaggggaaacctaaagccttcgcccctcaccacgtccgaccgggggccaggcaagacagtgaatgtgattatcacgtcgtacgttctttagtggtggggtcgtggtcgttaggtttggggtcggttcggggcgggaacgggtaaccgttaaacggtccggacccggttaccgtaacgggttccgaccggaccccgaacgggtcccgtcccgtcccccgttcgggaccctaaccgttcccgtttccccggg

SEQ ID NO: 362584 - DNA, 629 bp, Homo sapiens
  misc_feature: GZ8MTXP01B9WRH.15.34.D01.1.454.CMB.2.raw
  modified_base (331)..(331): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgtccttggaggtctggctacagttctctacttactaactaccgccgtccgtggtacccggcacgaccccaggcccacgccctccacgcacgctcatctaacagtaaccaacnctcgcttccgttccgggtccctgacttcccgcttctcgtcgtctaccctattccgtagggaaacacggctccgccctcaccacgtccgaccgggggcccaggacaagacgtagtagaagtggtactaattactcgtaacgtcggttcgttccgtttagtgggtcgggtcggtaggtcggtggtttcggggtaggttcggggtacgggaacggtaccgaaacgtcgacccgttacgtagttccgttacgcccgtaacggtccctccgtcccccgtcgttaccctccgttccgttccccg

SEQ ID NO: 362585 - DNA, 585 bp, Homo sapiens
  misc_feature: GZ8MTXP01EMF7K.15.34.D01.1.454.CMB.2.raw
  modified_base (357)..(357): a, c, t, g, unknown or other
  modified_base (391)..(391): a, c, t, g, unknown or other
  modified_base (417)..(417): a, c, t, g, unknown or other
  modified_base (424)..(424): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactggtggtgacccaggagccatcgttctcagtgtcccctgggagggacagtcacactcactttgtgtccttgaggtctggctcagtctctacttctaactacgccgctggtaccggcacgaccccaggccacgcctccacgcacgctcatctaacagtaacaaacactcgctcgttccgggtcctgactccgcttctntcgctccatcgtagggaaacaaacgctcgccctnaccagtcgacggggccaggcagacgntagatgnattatcactgtcgttctttagtcggtgggcgtgggacgttgtttggggttcggttcggggcgggaacgggtaaccttaaacggtcgttaaccggtccgtaagggttcgacgttaccccggaaggccttcccggccccgttcgggcctccttccgttccccg

SEQ ID NO: 362586 - DNA, 653 bp, Homo sapiens
  misc_feature: GZ8MTXP01EIWP2.15.34.D01.1.454.CMB.2.raw
  modified_base (288)..(288): a, c, t, g, unknown or other
  modified_base (293)..(293): a, c, t, g, unknown or other
  modified_base (315)..(315): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgctggaccgcacgacccagccacgcccnccacncacgctcatcacagtaacaacnctcgctccgttccgggtcctgctccgtcttctcgtcgctaccatccgtagggaaacaacgcctcgcccctcaccacgtccggaccggggcccaggcagacgatagtaatgtagtattaactcctacggttcggtccgtttaccgtttaggtgggttcgggggtccggttgggtacgtttagggttttcgggggttcgggtttaccggggacggggaaaccgggtaacccgttaaaccggtccggttacccgttaccggtaacggttccgaccgaccccggtaacggtcccgtccccgtcccccgttccggttacccttccgtttcccgtttaaccccg

SEQ ID NO: 362587 - DNA, 560 bp, Homo sapiens
  misc_feature: GZ8MTXP01ABYUV.15.34.D01.1.454.CMB.2.raw
  modified_base (318)..(318): a, c, t, g, unknown or other
  modified_base (429)..(429): a, c, t, g, unknown or other
  modified_base (457)..(457): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctcgttaccgggccctgactccgctctcgtcgactccattcccgttagggaaaccaaagctcgccctcaccatcgacggggccaggcagacgatgaatgtagattancacgtgcgttctttagcgtggggctggngtgtttggggtcgttcgggcgggtaacggaccaaacgtcgaccgtcgtaacggttcgcgcccgaagggcctccgtccccctcggttacctccttccgttcccg

SEQ ID NO: 362588 - DNA, 617 bp, Homo sapiens
  misc_feature: GZ8MTXP01ALVWY.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtcgccttggaggtctggctcagtctctacttctaactcgccgcgtggtaccgcacgaccccaggccacgccctccacgccacgctcatctacagtacaaacactcgcttccgttccgggtcctgactccgctttctcgtcggcctcctattcccgttaggggaaaccaaaggcctacgacccctcaaccctacgtccggaccgggggcccagggacaaggacgtatagaatgtagtaattacgtccacggttcgtccgtttccgtttagtcgggtgggtcgtggtcgttaggtttggggtacggttcgggacgggtaacggaaccttaagtcgaccgtcgtacgttcgcggaccgaaggccctccgccccgtcggttcctccgttccgttccccg

SEQ ID NO: 362589 - DNA, 616 bp, Homo sapiens
  misc_feature: GZ8MTXP01A9YYC.15.34.D01.1.454.CMB.2.raw
  modified_base (397)..(397): a, c, t, g, unknown or other
  modified_base (436)..(436): a, c, t, g, unknown or other
  modified_base (439)..(439): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttcaactacgccgcctcggtaccggcacgaccccaggccagccctcacgcacgctcatcacagtacaaacactcgctcgttccgggtcctgactccgcttctcgtcggcctacccattccgttagggaaacaaacgctcgccctcacccntccggacggggcccaggcagacgatagagtgtgacttanacnctcgtccgttcgtttagtgggtcggggcgttggcgttggtttcggggtcggttcggggcgggaacggggtaaaccttaacggtcggttaccgtaccggtacggttccgacggccccggtaacgggtccctcccggtccccccgtcgggttaccccgtaactttcccggtttcccccg

SEQ ID NO: 362590 - DNA, 546 bp, Homo sapiens
  misc_feature: GZ8MTXP01B3U2O.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagccctccacgcacgctcatcacagtacaaacactcgctcttccggggtcctgactccgcttctctcggctccatccttgggaaacaaagctcgccctcaccatcgacggggcccaggcagacgagtgaatgtgattatccacgtgtcgttcctttagtgggtggggcgtggcgtgtttgggtgttcgggcggaacgggaccaaacgtcgaccgtccgtaggcgcgccccgaaggcctcgcccctcggttcctccgttcgtcccg

SEQ ID NO: 362591 - DNA, 577 bp, Homo sapiens
  misc_feature: GZ8MTXP01BFS1C.15.34.D01.1.454.CMB.2.raw
  modified_base (389)..(389): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgacccccaggccagccctccacgcacgctcatctacagtacaaacactcgctcttccggggtccctgactcccgcttctctggctcatcctgggaaacaaagctgccctcaccancgacggggcccaggcagacgatagaatgtagattacgtcacgtcgtcgttcctttagtcgggtggggcgttggtacgtagtttgggggtggttcggggcgggtaacgggaaccaaaacgtcggaccgtaccgttaggcgacgcccgaaggcctccgcccccgtggttcctaaccgttccgttccccgg

SEQ ID NO: 362592 - DNA, 607 bp, Homo sapiens
  misc_feature: GZ8MTXP01EPVN0.15.34.D01.1.454.CMB.2.raw
  modified_base (315)..(315): a, c, t, g, unknown or other
  modified_base (346)..(346): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccgcacgaccccaggcccagccctccacgcacgctcatctacagtacaaacnctcgctcgttccgggccctgactccgcttcnctgcctccatccttgggaaacaagctcgccctcaccactcgaccgggggcccagtcgcaagacgagtgaatcgtgtattatctactaggtccgttccgtttagtcggtggggtcgttggtcgttaggtttcggggttcggtttcggggaacgggtacgggaaccgaaacggttccgtacccggtacgttacgggttccgaccggtaaccccgaacgggtcccgttacccgcccccgttccgggtcccttaacgtttccccg

SEQ ID NO: 362593 - DNA, 587 bp, Homo sapiens
  misc_feature: GZ8MTXP01BO2BE.15.34.D01.1.454.CMB.2.raw
  modified_base (222)..(222): a, c, t, g, unknown or other
  modified_base (239)..(239): a, c, t, g, unknown or other
  modified_base (317)..(317): a, c, t, g, unknown or other
  modified_base (483)..(483): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgngccttgaggtctggctnagtctctacttcaactacgccgcctggtaccgcacgaccccaggccagcctccacgcacgctcatcacagtacaaacnctcgctcgttaccgggccctgactccgcttctcgtcgcctaacccattcccgttagggaaacctaaacggctacgcccctacacccaactccggaaccgggggcccaggggaccaggaaccgtagtagaactggtagaattacactacgtcggtcgttcctttagnggttggggcgtggcgttgtttggggtgttacggcgggaacggacaaacgtgaacccgtcgtcgcgcgccgaacggcctcgcccccgtgttcctcgttcctcccg

SEQ ID NO: 362594 - DNA, 604 bp, Homo sapiens
  misc_feature: GZ8MTXP01EWUVS.15.34.D01.1.454.CMB.2.raw
  modified_base (384)..(384): a, c, t, g, unknown or other
  modified_base (479)..(479): a, c, t, g, unknown or other
  modified_base (498)..(498): a, c, t, g, unknown or other
  modified_base (531)..(531): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactctacttgtcgccttggaggtctggctcagttctcttacttactaactaccgccgccgtggtaccgcacgaccccgaggccacgccctacccacgccacgcctacacttctaacaacgtaaccaaaactccctcgtaccgttccggttcccgggtccctgtactcccgtcttcngtcgccctacctattccgtaagggaaactaacgctacgccctacaaccacgtcccggaccggggcccaggacagaacgatagaatgtatattacncagttcgtcgttacttggnggtgggcgtagcgtttaggttgggtagtcgggngggaacgacttaaacgcgttcgtacgtcgacgcacccgtaaggcctccgcccgtgttacctccttcgtccccg

SEQ ID NO: 362595 - DNA, 613 bp, Homo sapiens
  misc_feature: GZ8MTXP01B5TBU.15.34.D01.1.454.CMB.2.raw
  modified_base (295)..(295): a, c, t, g, unknown or other
  modified_base (322)..(322): a, c, t, g, unknown or other
  modified_base (570)..(570): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactggtggtgacccaggagccattcgttctcagtcgtccccgtggagggacagtcacactcacttgtcgccttggaggttctggctcgagtcttctacttactaactacgccgcgtcggtaccgcacgcccaggccagccncacgcacgctcatcaacgatacaaacnctcgctcgttccgggtcctgcttcccgcttctctcgcctacctactccgttagggaaacctaaagcctcgtcccctcgaaccctacgtccgggaccggggacccgaggccaaggacgtatagaatggtatacttagtaccacggtcgttcggtttcctttaggtcggggtggggtccggttagtccgttggttggggtcgttcgggacgggaacgaaccgttaaacgtcgttaccgtacgttcgggcncgttacccggaagtctcccgcccctgccctcgttccgttcccg

SEQ ID NO: 362596 - DNA, 636 bp, Homo sapiens
  misc_feature: GZ8MTXP01BUDAK.15.34.D01.1.454.CMB.2.raw
  modified_base (334)..(334): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccattcgttctcagtcgtccccgtgggagggacagtcacactcacttgtgtccttggaggtctggctcagtctctacttctaactaccgccgccgtcggtacccggcacgaccccaggcccacgccctccgacgcacgctcatctacaagtaacaacnctcgctccgttccgggtcctgactccgtcttctcgtcgtctacccattccgtagggaaacaacgtctcgccctacaccacgtccggaccggggcccaggaccgagacgatagaatgtagtaacttatccgtacggttcgttccgtttcgtttaggtggggtcgggtcggtggtcgttagggtttcggggttggtcggggcgggaacgggtaaccgttacggtccggaccgttccgtacggttccgacggacccgaacggtccctcccggtcccccgtcggttcctcccgttcccgttccccg

SEQ ID NO: 362597 - DNA, 566 bp, Homo sapiens
  misc_feature: GZ8MTXP01AJRAG.15.34.D01.1.454.CMB.2.raw
  modified_base (443)..(443): a, c, t, g, unknown or other
  modified_base (482)..(482): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcgagtctctacttactaactacgccgctggtacccggcacggaccccaggccacgcctccacgcacgctcatcacagtacaacactcgctcttccgggtcctgactccgcttctctacgcctaccacgtccgttagggaaacctaaagcctcgccctacaccactccgaccgggggcccagggcagacgtatagaagtgtagaattacnctaacgtgtccgttcgtttagtgggtcgggtacgtcggngttaggttgggtcgttcgggcggaacgggtacaagtcgacgtcgtacgcgcgccgaaggcctcggccctgttactcttcgtccg

SEQ ID NO: 362598 - DNA, 735 bp, Homo sapiens
  misc_feature: GZ8MTXP01AYT8F.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcagggagtggattctcagactgtggtgacccaggagccatcgttctcagtcgtccccgtggaggacagtcacactcacttgtcgccttgaggtctggctcagtctactacttactactacgccgctggtccggcacgacccaggccagccctccacgccacgctacactcctacaacgtaaccaaacctacctcgccgtttaccggttcccgggggtcccctgtacttccccgcctttctccgtcgacccttaccgtaccgtttcccggttaaggggaaaccctaaacggtccttcccggacccccttacgaaccccgtaacgtcccggggaaccccgggggcccgaacgggcaacggtaaccgaagttaagaattggttataacgtttactaccgtacggttcgttaccggtttaccgtttaggttcgggggtcggggtccggttagggtccgtttgggttttcgggggttcggttaccggggtaccggggaacgggtaaccttaaacggtccggttaacccgtccgtacgttaccgacgttaccccgaaggtcccgtaacccgtccccgtggttccctaacgttcccttaaccccg

SEQ ID NO: 362599 - DNA, 583 bp, Homo sapiens
  misc_feature: GZ8MTXP01AKO29.15.34.D01.1.454.CMB.2.raw
  modified_base (317)..(317): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacnctcgctcgttccgggcctgactccgcttctcgtcggcctaccattcccgttagggaaaccaaaggctcgacccctcacccagtccgaccgggggcccagggccagacgatagaatgtagattatcacgtgtcgttctttagtggtgggcgtggacttggttgggtcggttcggcgggtaacggaaccttaacgtcgaccgtcgtacggttccgcgttacccaagggcctccggtcccccgtggttcctaaccgttccgttccccgg

SEQ ID NO: 362600 - DNA, 632 bp, Homo sapiens
  misc_feature: GZ8MTXP01ESE88.15.34.D01.1.454.CMB.2.raw
  modified_base (220)..(220): a, c, t, g, unknown or other
  modified_base (332)..(332): a, c, t, g, unknown or other
  modified_base (417)..(417): a, c, t, g, unknown or other
  modified_base (468)..(468): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgaccaggagccatcgttctcagtcgtccctggaggacagtcacactcacttgtncctgagtctgctcagtctctacttcactacgcgctgacgcacgacccagccagcctccacgcacgctcatactacaataacaacactcgctcgttccgggtccctgactccncttctcgcgcctacccatcccgttagggaaacaaacgtctacgtcccacaaccgactcggaccgggggcccagggacaggtaaanagtagaatgtataattacgtactacggttcgttcgtttacgttaggtgggngggttcggtacggttacgttaggttttcggggtagggttaccgggaacggggaaaccggtaaacgttaaaccgtccggttaacccgtacggtaacggttcgacccgttacccgaacggtccccgtcccggccccgttaccgttaccttccgtttccgttccccg

SEQ ID NO: 362601 - DNA, 591 bp, Homo sapiens
  misc_feature: GZ8MTXP01A28F7.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaacactcgctcttccggggtcctgactcccgcttctctggctccatccgttagggaaacaaagctgcccctcaccatcgacggggccaggcagacgatgaatgtgattatcacgtcgtcgttcctttagtggtggggtcgtggtcctaggtttggggtaggttccgggcgggtaacgggacccgttaaaacgtcggacccggttaccgtacgggttaccgacggaccccgtaacgggccctccggtcccccgtccgggttcctccgttccgtttccccgg

SEQ ID NO: 362602 - DNA, 647 bp, Homo sapiens
  misc_feature: GZ8MTXP01AHJJ0.15.34.D01.1.454.CMB.2.raw
  modified_base (291)..(291): a, c, t, g, unknown or other
  modified_base (320)..(320): a, c, t, g, unknown or other
  modified_base (340)..(340): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacagtcacactcacttgtgccttgaggtctggctcagtctctacttctaactcgccgcctggtaccgcacgaccccaggccacgcccnccacgcacgctacatcaacagtaacaacnctccgctccgttccgggccngactcccgcttctcgtcggcctaacctacgttccgttaggggaaaaccaaaggtcctccgacccctacaacccgtacgtaccgggaacccgggggacccaggggaccaaggacgaagtgaatgtagtattactacgtacgtggtaccgtttcgtttaggtggtggggtcgtgggtccgtaggtttggggtcggttacggggcgggaacgggaaccttaacggtccggacccggtcgtaaccggttcgacggcccgaacggtccctcccggtcccccgtacggttccctaaccgttccgtttcccccg

SEQ ID NO: 362603 - DNA, 578 bp, Homo sapiens
  misc_feature: GZ8MTXP01D8TK2.15.34.D01.1.454.CMB.2.raw
  modified_base (320)..(320): a, c, t, g, unknown or other
  modified_base (328)..(328): a, c, t, g, unknown or other
  modified_base (331)..(331): a, c, t, g, unknown or other
  modified_base (342)..(342): a, c, t, g, unknown or other
  modified_base (344)..(344): a, c, t, g, unknown or other
  modified_base (348)..(348): a, c, t, g, unknown or other
  modified_base (352)..(353): a, c, t, g, unknown or other
  modified_base (359)..(359): a, c, t, g, unknown or other
  modified_base (370)..(370): a, c, t, g, unknown or other
  modified_base (372)..(372): a, c, t, g, unknown or other
  modified_base (377)..(377): a, c, t, g, unknown or other
  modified_base (379)..(379): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtgccgttgaggtctggctcagtctacttaccttactaactaccggccgtccgtggtacccgcacgaccccaggcccagccctccacgcacgctcatcanagtacacnctnctcgtccggcngntccnctcnngctacntcgtagaacancncgccncncagcgacgggcagcagacatagatgtagattaactcgtaacgttcgtccgtttacgtttagtcggggtggtcggtggtacgttggttcggggtgtccggggtacggaacggtaaccgttaaacgtcggttacccgtacgtacggccgcgttacccggaacgtccgtcccggtcccctggttaccctcgttccgttcccg

SEQ ID NO: 362604 - DNA, 527 bp, Homo sapiens
  misc_feature: GZ8MTXP01B2CIJ.15.34.D01.1.454.CMB.2.raw
  modified_base (237)..(237): a, c, t, g, unknown or other
  modified_base (322)..(322): a, c, t, g, unknown or other
  modified_base (340)..(340): a, c, t, g, unknown or other
  modified_base (351)..(351): a, c, t, g, unknown or other
  modified_base (361)..(361): a, c, t, g, unknown or other
  modified_base (381)..(381): a, c, t, g, unknown or other
  modified_base (385)..(386): a, c, t, g, unknown or other
  modified_base (395)..(395): a, c, t, g, unknown or other
  modified_base (397)..(397): a, c, t, g, unknown or other
  modified_base (403)..(404): a, c, t, g, unknown or other
  modified_base (415)..(415): a, c, t, g, unknown or other
  modified_base (435)..(435): a, c, t, g, unknown or other
  modified_base (459)..(459): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctnagtctctacttctaactccgccgcgtggtacccgcacgacccccaggccctagccctccacgcacgctcatctacagtacaaacnctcgcttcgtcgggtccngactccgcttntctgctaccntcgtggaaacagctgccctnaccnncgacgggcngnagacannaatgcgtatancagtcgtcgttcttagtggnggtcgtgcgtgttggtggttcggnggaacggaacaacgtgaccgtcgtcgttcgcgttcccgaagtcgccgcccgtcgcctcttcgttcccg

SEQ ID NO: 362605 - DNA, 572 bp, Homo sapiens
  misc_feature: GZ8MTXP01C5OTQ.15.34.D01.1.454.CMB.2.raw
  modified_base (318)..(318): a, c, t, g, unknown or other
  modified_base (336)..(336): a, c, t, g, unknown or other
  modified_base (348)..(348): a, c, t, g, unknown or other
  modified_base (438)..(438): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactcgccgctggaccggcacgaccccaggccagccctccacgcacgctcatctacagtacaacnctcgctcttccgggtccngactccgcttcnctgctccatccgtagggaaacaagctcgccctacaccacgtccgaccgggggcccagggaccaaggacgtagtagtaagtgtagatttanccgtacgtcgtcgttcctttagtggtggggcgtggtactggtttgggtgttcgggcggaacggaacaaacgtcgaccgtccgtggttcgcgcccgaaggcctccggtccccgtcggttcctcgttctttccccg

SEQ ID NO: 362606 - DNA, 630 bp, Homo sapiens
  misc_feature: GZ8MTXP01DQ6BG.15.34.D01.1.454.CMB.2.raw
  modified_base (320)..(320): a, c, t, g, unknown or other
tcagtctacgtagccacgaccggtgctcgatttagatcgtctgtgttgggtttggggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttggaggtctggctcagtctctacttctactacgccgctggtaccggcacgcccaggccacgcctccacgcacgctcatctacagtacaaacnctcgctcgttccgggtcctgactccgcttctcgtgcctaccactcgttagggaaacaaagcctcgccctcaccgagtccggaccggggccaggcaggaacgtgtagtaactggtagtattatcctacgttcggtcgtttcctttaggtcgggtcggggtcgtgggtacttgggttttggggtcggttcgggcgggggtaacgtaaccgttaaacgttcgggaccgttaccgtacgggttaccgcgggaccccgaacgggtcccgtcccggtccccgttaccggttccgttaacccgttcccgtttccccg

SEQ ID NO: 362607 - DNA, 590 bp, Homo sapiens
  misc_feature: GZ8MTXP01ADD95.15.34.D01.1.454.CMB.2.raw
  modified_base (284)..(284): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttcaactacgccgctggaccgcacgaccccaggccagcccncacgcacgctcatctacagtaacaaacactcgcttcgtcccgggtcctgactccgcttctcgtcgctaccatccgtagggaaacagcctgcccctacaccacgtccgacgggggcccagggccagaacgatagaagtgtagaattactcacggtgtccgttcctttagtgggtggggtcgtggtcgttagggtttggggtcggttcggggacgggaagggtaacccgaaacgtcggacccgtcgtacggttccgaccggttccgaacgccgtcccggtccccgtcggttcctccttccgttccccg

SEQ ID NO: 362608 - DNA, 566 bp, Homo sapiens
  misc_feature: GZ8MTXP01ATKI6.15.34.D01.1.454.CMB.2.raw
  modified_base (347)..(347): a, c, t, g, unknown or other
  modified_base (380)..(380): a, c, t, g, unknown or other
  modified_base (387)..(387): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacgttgtgccttgagtctggctcagtctctacttctaactacgccgctggtaccgcacgacccaggccagccctccacgcacgctcatctacagtacaacactcgctccgttccgggtccctgactcccgcttcncgtgctcactcgtagggaaacaagctcgccctnacctacncgaccggggccagggaccagggtaacatagaagtgtagtacttaatcacgtcgtccgtttccgtttagtgggtcgggcgtgtacgtgtttggggtgttcgggcggaacggaccaaagtcgaccgtccgtaggcgcgccgaacgtccgtcccgccccgtcggttcctcgttcgttccccg

SEQ ID NO: 362609 - DNA, 628 bp, Homo sapiens
  misc_feature: GZ8MTXP01BDZCV.15.34.D01.1.454.CMB.2.raw
  modified_base (289)..(289): a, c, t, g, unknown or other
  modified_base (312)..(312): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtcgccttgaggtctggctcagtctctacttcaactcgccgctggaccgcacgacccagccagcctcacncacgctcatctacagtacaaacnctcgctcttccgggtcctgactcccgcttctcgtgtacctccatccgttagggaaacaacgcctcgccctacacccagtccggaccgggggaccagggccagggtaacctagtaggaatggtataatttataccacgttggttaccgttccgtttagtcggtcgggggtccttgggtaccttggttttcgggggtcgtttccggggacgggtaacggggtaaaccccttaaaggttcgaccccggttaccgtaggaccgacgacccggtaagcccgttccgacccccgttcggttaccctaacgttcccttccccg

SEQ ID NO: 362610 - DNA, 566 bp, Homo sapiens
  misc_feature: GZ8MTXP01BZY06.15.34.D01.1.454.CMB.2.raw
  modified_base (320)..(320): a, c, t, g, unknown or other
  modified_base (431)..(431): a, c, t, g, unknown or other
  modified_base (458)..(458): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagttctcttacttcaactacgccgcgtggtaccggcacgaccccgaggcccagccctccacgcacgctcatctacagtacaaacnctcgctcgttccgggtcctgactccgcttctctcgctaccatccgtagggaaaccaagctacgccctcgacagtcgaccggggccaggcagacgatgaatggtacattacnctacgtcgtcgttcgttggtggtcggngtggtacgttggtttgggtcgtcgggacggtaacggaacttacggtcgttacgtcgacgttcgccgaccgaacggtcctccgtcccgtcgttacctccgttccgtccg

SEQ ID NO: 362611 - DNA, 635 bp, Homo sapiens
  misc_feature: GZ8MTXP01AETT6.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagttctctacttctaaactccgccgcctcggtacccggcacgaccccaggccacgccctccacgcacgctcatcacagtacaaactctcgtctccgttccggggtcctgctccgtcttctcgtcgcctccacgttccgtagggaaaccaagcctacgtccctcacccacgtccggaccgggggcccaggcagacgtatagatgtgtattatctacgtcgttcgttaccgtttagtggggtcgggtcgttggtcgtttagggttttcgggtcggtttccggggaacggggtaacggaacccgttaaacgtccggacccggttaccgttaacggccgaccgacccggtaacggtcccgtcccggtcccccgttcgggttccctccgttcccgttcccccgg

SEQ ID NO: 362612 - DNA, 560 bp, Homo sapiens
  misc_feature: GZ8MTXP01DNHSI.15.34.D01.1.454.CMB.2.raw
  modified_base (286)..(286): a, c, t, g, unknown or other
  modified_base (314)..(314): a, c, t, g, unknown or other
  modified_base (324)..(324): a, c, t, g, unknown or other
  modified_base (392)..(392): a, c, t, g, unknown or other
  modified_base (426)..(426): a, c, t, g, unknown or other
  modified_base (431)..(431): a, c, t, g, unknown or other
  modified_base (481)..(481): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcagggagtggattctcagactggtggtgacccaggagccattcgttctcagtcgtccccgtgggagggacagtcacactcacttgtgccttggaggttctggctcagtctctacttctaactcgccgctggtaccgcagaccccnggccagcctccacgcacgctcatcctanagtacaaacnctcgctcgttccgggtcctgactcgctctctgctccatccgtagggaaacaagcctacgccctcaccntccgacggggccagggctagacgattagaatgtnattancacgtgcgtttcttatgggcgggtgtggtactaggtttggtcggtcgggnggaacgggaccaaacgtcgaacccgtcgtacgttccgcgttacccgaaggcctccggcccctggttctcgttcttcccg

SEQ ID NO: 362613 - DNA, 606 bp, Homo sapiens
  misc_feature: GZ8MTXP01EBSXS.15.34.D01.1.454.CMB.2.raw
  modified_base (319)..(319): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggcccagccctccacgcacgctcatctacagtacaaacnctcgctcgttccgggcctgactccgctttctctggcctaccattccgttagggaaacaaagctcgcccctcaccactcgacggggcccagggcagacgatagaatgtagattaagtcacgttgtcgttccgtttagtgggtggggcgtaggtccgttaggtttggggttcggttcgggcggggtaacgggtaaccaaacgttcggaacccggttccgtaacgggttaccgacggaccccgaaggcccgtccggcccccgtcgggttcctaaccggttcctttccccg

SEQ ID NO: 362614 - DNA, 651 bp, Homo sapiens
  misc_feature: GZ8MTXP01A4KYY.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccattcgttctcagtcgtccccgtggagggacagtcacactcacttgtgccttgaggtctggctcagtctctacttcaactcgccgcctggtaccggcacgaccccaggccacgccctccgacgcaccgctcatcaacagtaccaacacctcgccgtccgttccgggtccctgactcccgtcttcgtctcggcctacctagttcccgttagggaaaccaaacggtcctacgcccctacaaccctacgtaccggaaccgggggcccaacgggccgaacggtaacgagttaagaacgttgtagtaacttaactccgtaacgttcggttaccgtttccgtttaggtgggtcggggtcgtggtcgttaggtttgggtcggttcgggcgggtaacggaaccaaacgtcgaccgtccgtaggttccgacgcccgaacggccctaaccgcccccgtcggttcctaaccgttccgtaaccccg

SEQ ID NO: 362615 - DNA, 603 bp, Homo sapiens
  misc_feature: GZ8MTXP01BWRWC.15.34.D01.1.454.CMB.2.raw
  modified_base (437)..(437): a, c, t, g, unknown or other
  modified_base (443)..(443): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtgccttgaggtctgctcagtctctacttctaactacgcgctggtaccgcacgacccaggccacgcctccacgcacgctcactctaacacgtaacaaacactcgctccgttccggggtccctgactccgtcctttctctcggcctaccctacttccgttaggggaaaccaaacgctacgcccctacacccagtccgacggggcccaggcagacgtanagtaangtagtattatcacgtcgtcgttactttagtggtggggcgtggtacgtagtttggggtcggttcgggacggggaacggaaccgttaacgtcgaccgtccgtaggttcgacggacccgaaggcccgtcgcccccgtcggttcctaaccgttcgttaaccccg

SEQ ID NO: 362616 - DNA, 611 bp, Homo sapiens
  misc_feature: GZ8MTXP01EF9EP.15.34.D01.1.454.CMB.2.raw
  modified_base (316)..(316): a, c, t, g, unknown or other
  modified_base (335)..(335): a, c, t, g, unknown or other
  modified_base (348)..(348): a, c, t, g, unknown or other
  modified_base (457)..(457): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactggtggtgacccaggagccatcgttctcagtcgtcccgtggagggacagtcacactcacttgtcgtccttgaggtctggctcagtctctacttacaactacgccgctggtaccgcacgaccccaggccagcctccacgcacgctcatccacagtacaacnctcgctcgttccgggtccngactcccgcttcncgtcgcctccagttccgttagggaaaaccaaacggtcctccgacccctacaaccctagtccggaccgggggaccccagggacaagaacgtagtagtaatggtatattanccgtaacgtgtcgttacgtttagtcgggtggggtcgtgtcgttaggtttggggtcgttcggggcgggtaacggaacaacgtcggaccgttcgtaggttacgcgaccgtaaccggctaacccggtccccctggttcctaaccgttccgttccccg

SEQ ID NO: 362617 - DNA, 707 bp, Homo sapiens
  misc_feature: GZ8MTXP01CVG8B.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttactaactacgccgccgtggtaccgcacgaccccaggccacgccctccacgcacgctcatctacaagtaacaaacactcgctcgttcccgggtcctgactcccgtcttctctcgcctaccatccgtagggaaacaaacggtctacgcccctacaccacgtcggaaccggggacccaggaccaaggacgagtagtaagtgtagtaattaacgtccaacggttcgtccgtttacctttagggtcggtcggggtcgtgggttacgttagggtttcggggtaggttcccggggacggggtaaaccggggtaaaccccttaaacggttacccgggttacccggtttaacccggttacgggttaacccgttacccgggaaaccccggtaacggggtccccgttccccgggtaacccccccgttcgggttacccctaacccgtttccccgttttaacccccccgg

SEQ ID NO: 362618 - DNA, 570 bp, Homo sapiens
  misc_feature: GZ8MTXP01EHPTO.15.34.D01.1.454.CMB.2.raw
  modified_base (528)..(528): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagttctctacttctaactacgccgcctggtaccggcacgaccccaggccagcctccacgcacgctcatctacatacaaacactcgctcttccgggccctgactccgcttctctggcctcccatccgttagggaaacaaagcctacgccctcaccatccgacggggcccaggcagacgatagaatgtagtattatcacgttcgtcgtttccttagtggtcggggtcgtggtcgtagtttggggtggttcgggacgggaacgggtaacccaaaggtcgaccgtacgtacggttacncgacccgaagcctccgcccccgtggttcctcttcgttccccg

SEQ ID NO: 362619 - DNA, 617 bp, Homo sapiens
  misc_feature: GZ8MTXP01A6OCR.15.34.D01.1.454.CMB.2.raw
  modified_base (313)..(313): a, c, t, g, unknown or other
  modified_base (456)..(456): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccgcacgaccccaggccagcctccacgcacgctcatctacagtacaaacnctcgctcgttcccggggcctgactcccgctttctcgtcggacctaccacttcccgttaggggaaacaaaggtcctcgccccctacacccgactccgaacccggggggcccagggccaggacgatagaacgtgtacgtacttanactcggtgtccgttcctttagtgggtcggggtcgtcggtacgttagtttggggtcggttacggggcgggtaacgggacccaaacgtcggacccgttacgtacggttcgacggcccgaaggtcctccgcccccgttaggttcctcccggttctttccccggg

SEQ ID NO: 362620 - DNA, 725 bp, Homo sapiens
  misc_feature: GZ8MTXP01EYVIJ.15.34.D01.1.454.CMB.2.raw
  modified_base (389)..(389): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccgtggaggacacgtcacactcacttgtcgcttgaggtctggctctagtctctacttctaacgtaccgccgcgtcggtaccgcacgacccgacggccacggcccctccacgccgaccgctaccaacttaccgtaacaacgtaaacaaacctacctccgtaccgttccgtttcccggggccctggtactccccgctttcncgtcggtcctacctactcccggtttagggaaacctaagggtcctcgtacccctacgaacccacgtccgggaacccgggggccgacggactacggaaccgtagttaggaacttaggtatacgtttataacccgtacgttccgtcgggtttaacccttagggtcgggttcggggtccggttcgggtaacgttggggtttcggggttcggttaccggggacgggtaacgggtaaccttaaaccggttcgggaccgttaccggttaaggacccgcggttacccgtaaccggtcccgtcccggtccccgttcgggttaccttcccggttccgtttccccgg

SEQ ID NO: 362621 - DNA, 578 bp, Homo sapiens
  misc_feature: GZ8MTXP01ESZ31.15.34.D01.1.454.CMB.2.raw
  modified_base (317)..(317): a, c, t, g, unknown or other
  modified_base (437)..(437): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggcccacgcctcccacgccacgctcatcacagtacaaacnctcgctcgttccgggtccctgactccgcttctctggcctccacttccgttagggaaacaaacgctacgccctacaccactccgaaccggggcccaggcagacgatagaatgtacgattanacgtacgtggtccgttcctttaggcggtggggtcgtggcgttagttggggtgttcgggcggaagggaccaacgtcgacccgtcgtacggttcgcgacccgaagggcctccgccccgtcggttcctaacgttccgttcccgg

SEQ ID NO: 362622 - DNA, 592 bp, Homo sapiens
  misc_feature: GZ8MTXP01ESH8C.15.34.D01.1.454.CMB.2.raw
  modified_base (319)..(319): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtgtccgttgaggtctggctcagttctctacttctaactacgccgcgtggaccggcacgaccccaggccacgcctccgacgcacgctcactcacagtacaaacnctcgctcgttccgggcctgactccgcttctctcgcctacatcgtagaaacagctcgcctcactcgtcgcggggccaggcagacgatagtaagtcgtagtattaatccgtacgttgttccgtttaacgttggtcggggtggggtcgttggtaacgttgggtttcgggtcgttacggggcggtaacgggtaccttaaagtcggttaaaccgtcgttaacggccgcgttacccgaacgtccgtcccgcccggtcttacctaaccgttccgttcccg

SEQ ID NO: 362623 - DNA, 509 bp, Homo sapiens
  misc_feature: GZ8MTXP02G5GOA.15.34.D01.1.454.CMB.2.raw
  modified_base (471)..(471): a, c, t, g, unknown or other
  modified_base (491)..(491): a, c, t, g, unknown or other
  modified_base (502)..(502): a, c, t, g, unknown or other
  modified_base (504)..(509): a, c, t, g, unknown or other
tcagtctacgtagccacgaccggtgctcgatttagatcgtctgtgttgggtttggggtccctgagactctcctgtgcagcctctggattcagttctagtaaatactggataagttgggtccgccaggctccagggaagggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggaggccggagtggtatttggatactttctggggccaggggacccctggtccaccgtctcctcagcctccaccaaagggcccatcggtcttccccctggcgcccctgctccaggagcacctccgagagcacagcggccctggggctgccctgggtacaaaggctacttccgntacgtagactgagcgggtcngcgacgcgcanannnnnn

SEQ ID NO: 362624 - DNA, 525 bp, Homo sapiens
  misc_feature: GZ8MTXP02IWKM3.15.34.D01.1.454.CMB.2.raw
tcagtctacgtagccacgaccggtgctcgatttagatcgtctgtgttgggtttggggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtccctgatccgcttctctgctccatccttgggaacaaagctgccctcaccatcacgggggcccaggcagacgatgaatgtgattatcactgcgtcctttatgtggggcgtggcagtttggggtgttcggcggtagggacccaaaatcgaccgtcctacgggtcacgcccaaggctcgccccctcggtccactctccg

SEQ ID NO: 362625 - DNA, 525 bp, Homo sapiens
  misc_feature: GZ8MTXP02GN9AD.15.34.D01.1.454.CMB.2.raw
  modified_base (371)..(371): a, c, t, g, unknown or other
  modified_base (518)..(525): a, c, t, g, unknown or other
tcagtctacgtagccacgaccggtgctcgatttagatcgtctgtgttgggtttggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggatactttcgtggggccaggggaccctggtccaccgtctcctcagcctcnccgaagggcccatccggtccttccccctgggccgccctgcctccgaggacgccacctcccgagacgcacagccggccctgggctgcctggtcaaggactacttccgctacgtacgactggacgcgggctcgggcaaggcgcataggnnnnnnnn

SEQ ID NO: 362626 - DNA, 547 bp, Homo sapiens
  misc_feature: GZ8MTXP02F8JK1.15.34.D01.1.454.CMB.2.raw
  modified_base (421)..(421): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctctccggggtcctgatccgcttctctggctccatcctgggaacaaagctgccctcaccatccgacgggggcccaggccagacgatagaatgtgattancactcgtcgttcctttagtggtggggcgtggctagtttgggtgttcgggcggacggaccgaaacgtcgaccgttccgtacggtcacgacccgaaggcctcgcccccgtcggtccactccgttcccg

SEQ ID NO: 362627 - DNA, 539 bp, Homo sapiens
  misc_feature: GZ8MTXP02HGJEC.15.34.D01.1.454.CMB.2.raw
  modified_base (315)..(315): a, c, t, g, unknown or other
  modified_base (420)..(420): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctctccggggtccctgatccgcttctctgctccatccttagggaacaaagctgccctcacccatcgaccgggggcccaggcagacgatgaatgtagattanctactgtcgtcctttagtggtggggcgtggctagtttgggtgttcgggcggtacgggaccaaacgtcgaccgtcgtacgtcgagcccgaaggcctcgccccctcggtccacctctcccg

SEQ ID NO: 362628 - DNA, 546 bp, Homo sapiens
  misc_feature: GZ8MTXP02G43Q6.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgtccggggtccctgactccgcttctctgctccatcctgggaacaaagctcgccctcaccatcgaccggggcccaggcagacgatgaatgtagattatcactgtcgttcctttagtggtggggcgtggtcgtaggtttgggtggttcgggcgggtacgggaaccaacgtcgaccgtcgtacgtcgacgcccgaaggcctccgcccctcggtcctactcgttcccg

SEQ ID NO: 362629 - DNA, 523 bp, Homo sapiens
  misc_feature: GZ8MTXP02JIQC0.15.34.D01.1.454.CMB.2.raw
  modified_base (410)..(410): a, c, t, g, unknown or other
tcagtctacgtagccacgaccggtgctcgatttagatcgtctgtgttgggtttggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatccgcttctctggctccatccttgggaacaaagctgccctcaccatcacggggcccaggcagacgatgaatgngattatcactgcgtcctttatgtggggcgtgggcatttgggtgttcggcggaggggaccaaactcgaaccgtcctaggtcagcccaaggctcgccccctggtccacgtctccg

SEQ ID NO: 362630 - DNA, 533 bp, Homo sapiens
  misc_feature: GZ8MTXP02IIFPX.15.34.D01.1.454.CMB.2.raw
tcagtctacgtagccacgaccggtgctcgatttagatcgtctgtgttgggtttggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggtccctgatccgcttctctggctccatccttgggaaacaaagcctcgccctcaccatcgaccggggcccaggcagacgatgaatgtgattatcactgtcgttcctttagtgtggggcgtggctagtttgggtgttcgggcggtacggaccaaacgtcgaccgtactacgtcagcccgaaggctcgcccctcggtccactctccg

SEQ ID NO: 362631 - DNA, 577 bp, Homo sapiens
  misc_feature: GZ8MTXP02H79K6.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaaacactcgctcgttccggggtccctgactccgcttctctggctccattccttgggaaacaaagctcgccctcacccatcgacggggcccaggcagacgatgaatgtgattatcactgcgttcctttagtggtggggcgtggtcgtagtttggggtgtttcgggcgggtaacggacctaaaacgtcggacccgttccgtaacggtccgtacggaccccgaaggccctaccggccccccgtcggtcctaccgttccttccccg

SEQ ID NO: 362632 - DNA, 521 bp, Homo sapiens
  misc_feature: GZ8MTXP02FL9SB.15.34.D01.1.454.CMB.2.raw
tcagtctacgtagccacgaccggtgctcgatttagatcgtctgtgttgggtttggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggcccagcctccacgcacgctcatctacagtacaaacactcgctctccggggtccctgatccgcttctctggctccatcctgggaacaaagctgccctcaccatcacgggggcccaggcagacgatgaatgtgattatcactgcgtcctttatgtggggcgtggcagtttggggtgttcgggcggagggacaaaaactgaccgtcctaggtcagcccaaggcctgccccctggtcactctccg

SEQ ID NO: 362633 - DNA, 518 bp, Homo sapiens
  misc_feature: GZ8MTXP02IK9EI.15.34.D01.1.454.CMB.2.raw
  modified_base (407)..(407): a, c, t, g, unknown or other
tcagtctacgtagccacgaccggtgctcgattagatcgtctgtgttgggttggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgatccgcttctctggctccatccttgggaacaaagctcgcctcaccatcacgggggcccaggcagacgatgaatgngattatcactgcgtcctttatcgtggggcgtggctagtttgggtgttcggcggtacggacaaactcgaccgtctacggtcacgccaaggctcgcccctggtccactctccg

SEQ ID NO: 362634 - DNA, 535 bp, Homo sapiens
  misc_feature: GZ8MTXP02H6O6E.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtaacaaacactcgctcttccggggtccctgatccgcttctctggctccatccttgggaacaaagctgccctcaccatcgacgggggcccaggcagacgatgaatgtgattatcactgtcgttcctttagtggtggggcgtggctagtttggggtgttcgggcggacgggaccaaacgtcgaccgtcgtacggcacgcccgaaggctcgccccctcggccactctccg

SEQ ID NO: 362635 - DNA, 553 bp, Homo sapiens
  misc_feature: GZ8MTXP02HFN19.15.34.D01.1.454.CMB.2.raw
  modified_base (422)..(422): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgatccgcttctctggctccatccttgggaacaaagctgccctcaccatcgaccgggggcccaggcagacgatgaatgtagattanctactgtcgttcctttagtcggtggggcgtggctagtttggggtgttcgggcgggagggacgaaaacgtcggaaccgtcgtacggtcacggcccgaaggctccgccccctcggtcctaccgtcgttcccgg

SEQ ID NO: 362636 - DNA, 564 bp, Homo sapiens
  misc_feature: GZ8MTXP02JP3BI.15.34.D01.1.454.CMB.2.raw
  modified_base (315)..(315): a, c, t, g, unknown or other
  modified_base (434)..(434): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctcggtaccgcacgaccccaggccagcctccacgcacgctcatctacagtacaaacnctcgctcttccggggtccctgactccgcttctctcggctccatccgttagggaaactaaacgcctcgcccctcacccactccgaccgggggcccaggcagacgatgaatgtagtattanctactgcgttactttagtggtggggcgtggctagtttgggtggttcgggcgggtacgggaccaaacgtcggaccgtcgtacgtcgacgacccgaaggcctaccggccccctcggtccaccgtcttcccgg

SEQ ID NO: 362637 - DNA, 538 bp, Homo sapiens
  misc_feature: GZ8MTXP02JVUSP.15.34.D01.1.454.CMB.2.raw
  modified_base (317)..(317): a, c, t, g, unknown or other
  modified_base (420)..(420): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacnctcgctcttccggggtccctgatccgcttctctggctccatccttgggaacaaagctgccctcaccatcgacgggggcccaggcagacgatgaatgtgattancactgacgtcctttagtgtggggcgtggcgtagtttggggtgttcgggcgggtacgggacccaaagtcggaccgtccgtacggtcacgcccaaggctcgccccctggccactctcccg

SEQ ID NO: 362638 - DNA, 553 bp, Homo sapiens
  misc_feature: GZ8MTXP02H6PDP.15.34.D01.1.454.CMB.2.raw
  modified_base (424)..(424): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggccagcctccacgcacgctcatcctacagtacaaacactcgctcttccggggtccctgactccgcttctctggctccatccttgggaaacaaacgctgcccctcaccatccgacgggggcccaggcagacgatgaatgtgattancactgcttcctttatggtggggcgtggtctagtttggggtgttcgggcgggtacgggaccaaacgtcggaacccgtcgtacggtccacggcccaaggcctcgcccccgtcggtcccacgttcctcccgg

SEQ ID NO: 362639 - DNA, 537 bp, Homo sapiens
  misc_feature: GZ8MTXP02IBE95.15.34.D01.1.454.CMB.2.raw
  modified_base (437)..(437): a, c, t, g, unknown or other
  modified_base (512)..(512): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtccctggagggacagtcacactcacttgtgccttgaggtctggctcagtctctacttctaactacgccgctggtaccggcacgaccccagccagcctccacgcacgctcatctacagtaacaacactcgctcgtccggggtccctgactccgcttctctggctccactccttagggaacaaacgctcgccctcaccactccgacggggcccaggcagacgatgaatgtagattatcactgtcttcttagngtgggcgtgctagtttgggtgttcgggcggacggaccgaaacgtcgtaccgtcctacggtcacgcccaacggccncgcccctcggtcctacgtcctcccg

SEQ ID NO: 362640 - DNA, 549 bp, Homo sapiens
  misc_feature: GZ8MTXP02GNPOI.15.34.D01.1.454.CMB.2.raw
  modified_base (316)..(316): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctcgttccggggtcctgactccgcttctctggctccatccgttagggaaacaaagctcgccctcaccatcgaccggggcccaggcagacgatagaatgagattatcacttgtcgttcctttagtggtggggcgtggctaggtttgggtggttcgggcggtacggggacaaacgtcggaccgtctacggtcacgccgaaggcctcggccccctggctacctcgttccccg

SEQ ID NO: 362641 - DNA, 566 bp, Homo sapiens
  misc_feature: GZ8MTXP02IRGGZ.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccggggtcctgactccgcttctcgtggcctccactccgttagggaaaactaaacgcctcgccccctacacccactccgaccgggggcccaggcagacgatgaatgtagattatcactgtcgttacctttagtgtgggcgtggcgtagtttgggtcgttcgggcggtacgggaccaaagtcgaaccgtccgtacgtccacgcccgaagcctccgacccccgtccggtccaccgtcttcccg

SEQ ID NO: 362642 - DNA, 611 bp, Homo sapiens
  misc_feature: GZ8MTXP02HWX3P.15.34.D01.1.454.CMB.2.raw
tcagtctacgtagccacgaccggtgctcgatttagatcgtctgtgttgggtttgggctcagagaggagccttagccctggactccaaggcctttccacttggtgatcagcactgagcacagaggactcaccatggaattggggctgagcttgggttttccttgttgctattttagaaggtgtccagggtgaggtgcaggtggtggaatcgtgggggagcttggtccaggccgtgggggtccctgagactctcctgtgcagcctctggattcagttctaagtaaatacgtggataaggtcggtccgccgaggctccgaggggagggctggagtggagtggaccaaatacgtagaaaccgaaggacggaagtagaataaacatacagtgtggctgtgtgccgaggggccattcgactatctacagacgaacaacgccaagaatcgtagtgtatttacgataaatacgaactagacctagacgacgaccgaacgacgacggcttgttagtatttacgcggttacggggacgggacggggtccggtaggtttaggttaagtttacggtacgttaccggtttcgggtacgggggtaccggtacgggggttaccccg

SEQ ID NO: 362643 - DNA, 610 bp, Homo sapiens
  misc_feature: GZ8MTXP02ICM3G.15.34.D01.1.454.CMB.2.raw
  modified_base (318)..(318): a, c, t, g, unknown or other
  modified_base (334)..(334): a, c, t, g, unknown or other
  modified_base (354)..(354): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctcgtccggtcngctccgtctctcgcgctccncttcgtaaggaaacacgtctccgccctacaccacgtccggggacccggggacccaggactaacgacgtagtagtaagtggtattattaactcgtacgtcggttcctttacgtttggtcggggttgggcggttggttacgtttggggtttggggtcgggtcggggaacgggtaaccggaaacctaacgtcgtacccgtacggttacgccgaaccgaccgaacgtcctcccgtcccgtcgtcctcgttccgttccccg

SEQ ID NO: 362644 - DNA, 549 bp, Homo sapiens
  misc_feature: GZ8MTXP02I0PIF.15.34.D01.1.454.CMB.2.raw
  modified_base (489)..(489): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttagaaggtgtccagggtgaggtgcaggtggtggaatcgtgggggaggcttggtccagccgtgggggtccctgagactctcctgtgcagcctctggattcagttctagtaaatactggataagttggtccgccaggctccaggggagggctggagtggatggaccaatatgaaaccaagacggaatgataaacatcatgtgggctctggtgcgaggggccgattcactatcctccagagacaacgccaaagaatctagtgttatttgacaaattgaacagaccctagagacgccgaacgacacggctgtcgtattacgngtggcggggacgggccggtagtggtaatttgggattacgttcgcggggccaggggtcccg

SEQ ID NO: 362645 - DNA, 553 bp, Homo sapiens
  misc_feature: GZ8MTXP02IBCJ9.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacactcgctcttccggggtccctgactccgcttctctcggctccatccttagggaaacaaagcctcgcccctcaccactccgaccgggggcccaggcagacgatgaatgtgattatcactgtcgttcctttagtggttggggcgtggtcgtagttttggggtgttcgggcgggtacgggaccaaacgtcgtacccgtcgtacggtccagcccgaaggctccgcccctcggtccactctcccg

SEQ ID NO: 362646 - DNA, 536 bp, Homo sapiens
  misc_feature: GZ8MTXP02I4X60.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtccctgatccgcttctctggctccatccttgggaaacaaagcctagccctcaccatccgaccgggggcccaggcagacgatgaattgattactcactgcgttcctttagtggtgggcgtggctagtttgggtgttcgggacggagggaccaaacgtcgaccgtcgtacgtcacgcccaagctcgccctcggtccactctcgttccccc

SEQ ID NO: 362647 - DNA, 551 bp, Homo sapiens
  misc_feature: GZ8MTXP02F542Z.15.34.D01.1.454.CMB.2.raw
  modified_base (428)..(428): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagccctccacgcacgctcatctacagtacaaaacactcgctcgttccggggtccctgactccgcttctctgctccatcctgggaaacaaagctcgccctcaccatccgacggggcccaggcagacgatagaatgtagattancactgtcgttctttagtgtgggcgtggctagtttgggtgttcgggacggtacgggaccaaacgtcgaccgtcgtacgtacacgacccgaaggcctccgccccctcggtcctccgtcttccccg

SEQ ID NO: 362648 - DNA, 553 bp, Homo sapiens
  misc_feature: GZ8MTXP02G6HRL.15.34.D01.1.454.CMB.2.raw
  modified_base (445)..(445): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggcccagcctccacgcacgctcatctacagtacaaacactcgctcttccggggtccctgatccgcttctctggctccatccttgggaacaaagctgccctcacccatcgacgggggcccaggcagacgatgaaatgtagatttatcaactgtacgttcctttagnggttggggcgtgggctagtttggggtgttcgggcggtacgggaccaaacgtcggaaccgtccgtacggtcacgcccaaggcctacgccccctcggtccactcttcccg

SEQ ID NO: 362649 - DNA, 545 bp, Homo sapiens
  misc_feature: GZ8MTXP02JHJ37.15.34.D01.1.454.CMB.2.raw
  modified_base (423)..(423): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgactccgcttctctgctccatccttgggaaacaaagctgccctcaccatcgaccgggggcccaggcagacgatgaatgtgattancactgcgttcctttagtgtggggcgtgggctagtttggggtgttcgggcggtacgggacccaaagtcggaccgtcgtacggtcacgacccgaaggctccgccccctcggtccactcttcccg

SEQ ID NO: 362650 - DNA, 523 bp, Homo sapiens
  misc_feature: GZ8MTXP02FG63J.15.34.D01.1.454.CMB.2.raw
  modified_base (345)..(345): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaaacactcgctcttccggggtcctgatccgcttcnctggctccatcctgggaacaaagctgccctcaccatcacgggggcccaggcagacgatgaatgtgattatcactgcgtcctttatgtggggcgtggctatttggggtgtttcggcgggaggggaccaaactcgaccgtcctaggtcagcccaaggctcgccccctggtcacgtctccg

SEQ ID NO: 362651 - DNA, 540 bp, Homo sapiens
  misc_feature: GZ8MTXP02GRNXZ.15.34.D01.1.454.CMB.2.raw
  modified_base (318)..(318): a, c, t, g, unknown or other
  modified_base (423)..(423): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacnctcgctctccggggtcctgactccgcttctctgctccatccgtagggaacaaagctcgccctcaccactcgaccggggccaggcagacgatagaatgtagattancacgtgtcgtctttagtggtgggcgtggctagtttgggtgtcggcggtacggacaaacgtcgaccgtcgtacgtccacgaccgaacggctccgtcccctcggtccacgtcgttcccg

SEQ ID NO: 362652 - DNA, 530 bp, Homo sapiens
  misc_feature: GZ8MTXP02F9Q09.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctggctccatccttgggaacaaagctgccctcaccatcacggggcccaggcagacgatgaatgagattatcactgcgtcctttatgtgggcgtggctagtttgggtgttcgggcggtagggaccgaaacgtcgaaccgtccgtacggtcacgcccaaggctcgcccctcggtccactcttcccg

SEQ ID NO: 362653 - DNA, 565 bp, Homo sapiens
  misc_feature: GZ8MTXP02J077S.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatcacagtacaaacactcgctctccggggtccctgactccgcttctcgtcggctccatcccgttagggaaacaaagctcgcccctcacccatccgaccgggggcccaggcaagacgatgaatgtagattactcactgcgttcctttagtggtggggcggtggcgttagtttggggtcgttcgggcggacgggtacccaaacgtcgtaacccgtcgtacggtccacgcccgaaggcctccggcccccgtcgtccacctcgttcccg

SEQ ID NO: 362654 - DNA, 507 bp, Homo sapiens
  misc_feature: GZ8MTXP02IJ8AO.15.34.D01.1.454.CMB.2.raw
  modified_base (329)..(329): a, c, t, g, unknown or other
  modified_base (370)..(370): a, c, t, g, unknown or other
  modified_base (398)..(398): a, c, t, g, unknown or other
  modified_base (421)..(421): a, c, t, g, unknown or other
  modified_base (496)..(496): a, c, t, g, unknown or other
  modified_base (499)..(507): a, c, t, g, unknown or other
tcagtctacgtagccacgaccggtgctcgatttagatcgtctgtgttgggtttggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggaggccggagtggtattggatactttcnggggccagggggaccctggtccaccgtctcctcagcctccnccgaagggcccatccgtctcccctggcnccctgctccaggagcacctcganagcacagcggccctgggctgccctggtcaaggactacttccgctacgtagactgacgcgggctggcaaggcgcanagnnnnnnnnn

SEQ ID NO: 362655 - DNA, 518 bp, Homo sapiens
  misc_feature: GZ8MTXP02GS7WH.15.34.D01.1.454.CMB.2.raw
  modified_base (497)..(497): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctgctccatcctgggaacaaagctgccctcaccatcacgggggcccaggcagacatgaatgtagattatcactgcgtcctttagtggtgggcgtggctagttgggtgtcggcggacgggaccaaacgtcgaccgtctagtccagcccaaggcncgccccgtcgtccactctccg

SEQ ID NO: 362656 - DNA, 525 bp, Homo sapiens
  misc_feature: GZ8MTXP02HL4EV.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtccctgatccgcttctctggctccatccttgggaacaaagctgccctcaccatcacggggcccaggcagacgattaatgtgattatcactgcgttcctttatggtggggcgtggcgtagtttgggtgttcggcggagggacaaacgtgacgtctacggtcacgccagcctcgcccctcggtcactctcgtccccg

SEQ ID NO: 362657 - DNA, 545 bp, Homo sapiens
  misc_feature: GZ8MTXP02J0PFG.15.34.D01.1.454.CMB.2.raw
  modified_base (446)..(446): a, c, t, g, unknown or other
  modified_base (481)..(481): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttgggtccagccgtggggggtccctgagactctcctgtgcagcctctggattcagttctagtaaatactggataagttggtccgcaggctccaggggaagggctggagtggatggccaaatatgaaaccaagacggaagtgataaacatcatgtgggctctgtgcaggggccattcactatctccagagacaacgccaagaatctagtgtatttgacaaatgaacngctagagagccgacgacgacggctgtgtattacgngtggcgggacggccggagtggtaagtttgggacttacgtttcgacgggggtccacgggggtccc

SEQ ID NO: 362658 - DNA, 539 bp, Homo sapiens
  misc_feature: GZ8MTXP02JXQTX.15.34.D01.1.454.CMB.2.raw
  modified_base (420)..(420): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactccgcttctctcggctccatccttgggaaacaaagctgccctcaccatcgacgggggcccaggcagacgatgaatgtgattancactgtcgtctttagtgtggggcgtggcgtagtttgggtggttcggcgggacgggaccaaacgtcggacccgtctacggtcacgcccgaaggctcgccccctcggtcctactcttcccg

SEQ ID NO: 362659 - DNA, 550 bp, Homo sapiens
  misc_feature: GZ8MTXP02HOCE3.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgtccggggtcctgactccgcttctctggctccatccgttgggaaacaaagctcgccctcaccatccgaccggggcccaggcagacgatgaatgtagtattatctactcgtcgttccgtttagtggtggggcgtggcgtagtttgggtggtcgggcggacggaccaaacgtcgaccgtcgtacgtcacgcccgaaggcctccgccccgtcggtccactcttcccg

SEQ ID NO: 362660 - DNA, 552 bp, Homo sapiens
  misc_feature: GZ8MTXP02JM9SW.15.34.D01.1.454.CMB.2.raw
  modified_base (416)..(416): a, c, t, g, unknown or other
  modified_base (429)..(429): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctcgttccggggtcctgactccgcttctctcggctccactccttgggaaacaaacgcctgcccctcaccatccgaccggggcccaggcagacgangaatgtagattancactgtcgtctttagtggtggggcgtggtcgtagtttggggtggttcggcgggacgggaccgaaacgtcgaccgtccgtacggtcacgcccgaaggctccggcccctcgtctacctcgtcccg

SEQ ID NO: 362661 - DNA, 525 bp, Homo sapiens
  misc_feature: GZ8MTXP02HP9J8.15.34.D01.1.454.CMB.2.raw
  modified_base (379)..(379): a, c, t, g, unknown or other
  modified_base (436)..(436): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgactccgcttctctggctccatccttgggaacaaagctgccctnaccatcgacggggcccaggcagacgatgaatgtagattatcactgtcgttctttagngtggggcgtggctagtttgggtgttcggcggagggaccaaatcgaccgtctacggtcacgccaaggctcgcccctggtccactcgtccg

SEQ ID NO: 362662 - DNA, 595 bp, Homo sapiens
  misc_feature: GZ8MTXP02JP3SP.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccgcacgaccccaggccagcctccacgcacgctcatctacagtacaacactcgctctccggggtccctgatccgcttctctcggctccatcccgttagggaaacaaagcctgccctacaccatcgaccgggggcccaggcagacatgaatgtagattatcactgccgttcctttagtggtggggtcgtcggtctaggtttggggtgtttcggggacgggtacgggaacccgaaaacgttcggaccccggttacgttacggtaccgtaacgaccccgtaaagggcccgtccggtccccccgtcgggtaccctacccgttctttcccccgg

SEQ ID NO: 362663 - DNA, 559 bp, Homo sapiens
  misc_feature: GZ8MTXP02G85SG.15.34.D01.1.454.CMB.2.raw
  modified_base (415)..(415): a, c, t, g, unknown or other
  modified_base (429)..(429): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgccctccacgcacgctcatctacagtacaaacactcgctcgttccggggtccctgatccgcttctctggctccatccgtgggaaacaaagctcgccctcaccactcgaccgggggcccaggcagacgangaatgtagtattancacgtcgtcgttcctttagtggtcggggcgtggtcgttaggtttggggtcggttcgggcgggtacgggacctaaacgtcggaccgtcgtacggtcacgccaaggcctcgccccgtcggtccactctcccg

SEQ ID NO: 362664 - DNA, 596 bp, Homo sapiens
  misc_feature: GZ8MTXP02JMA8E.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcagaccccaggccagcctccacgcacgctcatctacagtacaaaacactcgctcttccggggtccccagtcgtccctcttctcgtcgtcctactcttcgggtaacgaaacaacgtcgcctcccaccacctacgaccggggacccggaccgacgacgaacgaactagaagtaagtgtattaatactctagtcgttaccgtttacttggtgggtcgggtggtgtgtttgggttgggttcgtcgggaacgggacggtaaaacctacggaccgtaccgtacgtacacgacgaccgaacgacgtccgtcccgtccgtacgtacctactccg

SEQ ID NO: 362665 - DNA, 572 bp, Homo sapiens
  misc_feature: GZ8MTXP02G81IC.15.34.D01.1.454.CMB.2.raw
  modified_base (321)..(321): a, c, t, g, unknown or other
  modified_base (436)..(436): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgacacgaccccaggccacgccctccacgcacgctcatctacagtaacaaacnctcgctcgttccggggtcctgactcccgcttctctggctccatccgttagggaaacaaagcctcgccctcacccatccgaccgggggcccaggcagacgatgaatgtagtattanctactgtcgttcctttagtggtcggggcgtggcgtaggtttgggtggttcgggacgggtacgggaaccaaacgtcggaccgtcgtacggtcacgacccgaacggccgtccgcccccgtcggtcctacctcttcccg

SEQ ID NO: 362666 - DNA, 545 bp, Homo sapiens
  misc_feature: GZ8MTXP02HUPFX.15.34.D01.1.454.CMB.2.raw
  modified_base (429)..(429): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgacccccaggccagcctccacgcacgctcatctacagtacaaacactcgctcttccggggtccctgatccgcttctctggctccatccgttagggaaacaaagctgcccctcaccatccgacgggggcccagggccagacgatgaaatgtagattancactgcgttcctttagtggtggggcgtggcgtagtttggggtgttcgggacgggacgggaccaaacgtcgaccgtcgtacggcacgcccaaggctcgccccctggtccactctccg

SEQ ID NO: 362667 - DNA, 537 bp, Homo sapiens
  misc_feature: GZ8MTXP02F3QBH.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacactcgctcttccggggtcctgactccgcttctctgctccatcctgggaaacaagctcgccctcaccatcgacggggcccaggcagacgatgaatgtagattatcactgcgttcctttagtggtggggcgtggcgtagtttgggtgttcggcggacgggaccaaacgtcgaccgtcgtacggtcacgacccgaaggccctcgccccctcggtccactcgtcccg

SEQ ID NO: 362668 - DNA, 537 bp, Homo sapiens
  misc_feature: GZ8MTXP02I1UXW.15.34.D01.1.454.CMB.2.raw
  modified_base (454)..(454): a, c, t, g, unknown or other
  modified_base (529)..(529): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactcgcttctctgctccatcctgggaacaaagctcgccctcaccatcgacggggcccaggcagacgatgaatgtagattactctaactgtcgttccctttagtggtggggcgtggntgtttggggtgttcggcggacggaccgtaaaacgtcgaccgtccttaggcacgcccaaggctcgcccctcggtcnctcttccg

SEQ ID NO: 362669 - DNA, 515 bp, Homo sapiens
  misc_feature: GZ8MTXP02GM59P.15.34.D01.1.454.CMB.2.raw
  modified_base (498)..(498): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcgttccggggtccctgactccgtcttctctgcctccatccgttgggaaacaaagcctcgccctcaccatccgacggggcccaggcagacgatgaatgagattatcactgcgttcttagtgtgggtcgtggctagttgggtgtcggcggaggaccaaatcgacgtcagtcagccaagcncgccctcgcactctccg

SEQ ID NO: 362670 - DNA, 543 bp, Homo sapiens
  misc_feature: GZ8MTXP02GGTFZ.15.34.D01.1.454.CMB.2.raw
  modified_base (412)..(412): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctggctccatccttgggaacaaagctcgccctcaccatcgaccgggggcccaggcagacgatgaatgngattatcactgcgttcctttagtcgtggggcgtggctagtttggggtgttcgggcggacgggaccgaaacgtcgaccgtccgtacggtcacggacccgaaggcctcgccccctcggtcctacgtcttcccg

SEQ ID NO: 362671 - DNA, 554 bp, Homo sapiens
  misc_feature: GZ8MTXP02JL8M0.15.34.D01.1.454.CMB.2.raw
  modified_base (420)..(420): a, c, t, g, unknown or other
  modified_base (437)..(437): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggcccagcctccacgcacgctcatctacagtacaaacactcgctcttccggggtccctgatccgcttctctggctccatccttgggaacaaagctgccctcaccatcgacgggggcccaggcagacatgaatgtgattancactgcgttcctttagngtggggcgtggctagtttgggtgttcggcggtacgggaccaaaacgtcgaacccgttccgtaacggtccacgaccccgaaaggcctaccgcccccgtcggtccaccgtctttccccg

SEQ ID NO: 362672 - DNA, 551 bp, Homo sapiens
  misc_feature: GZ8MTXP02H5HAH.15.34.D01.1.454.CMB.2.raw
  modified_base (420)..(420): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccagccagcctccacgcacgctcatctacagtaacaaacactcgctctccggggtccctgactccgcttctctcgctccactccttgggaaacaaacgctcgcccctcacccagtccgaccgggggcccaggcagacgatgaatgngtatatcactcgtcttcgtttagtggtgggcgtggtcgtagtttcgggtgttcggcgggtaacggaccgaaacgtcgaccgtccgtacggtcacgcccaaggcctccgccccgtcggtccacgttctcccg

SEQ ID NO: 362673 - DNA, 541 bp, Homo sapiens
  misc_feature: GZ8MTXP02GKJUZ.15.34.D01.1.454.CMB.2.raw
  modified_base (424)..(424): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccgcacgaccccaggccacgcctccacgcacgctcatctacagtacaaacactcgctcgtccggggtccctgactcccgcttctctggctccatccgttgggaaacaaagctcgccctcaccactcgaccgggggcccaggcagacgatgaatgtgattancatgcgttcttagtggtgggcgtggctagtttgggtgttcgggcggaacggggaccaaagtcgaaccgtcgtacggcacgacccgaaggcctcgccccctggtccaccgtcttcccg

SEQ ID NO: 362674 - DNA, 558 bp, Homo sapiens
  misc_feature: GZ8MTXP02IROMB.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggcctgatccgcttctctggctccatccttgggaacaaagctcgccctcaccatcgacgggggcccaggcagacgatgaatgtgattatcactcgcgttcctttagtggtggggcgtggcgtagtttgggtggttcgggcgggtaacgggacctaaaacgtcggaacccgttcgtacgggtaccacgacccgaacggcctcggcccccgtccggtcctaccgttcttcccg

SEQ ID NO: 362675 - DNA, 539 bp, Homo sapiens
  misc_feature: GZ8MTXP02HPJRY.15.34.D01.1.454.CMB.2.raw
  modified_base (436)..(436): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatccgcttctctggctccatccttgggaacaaagctgccctcaccatcgacgggggcccaggcagacgatgaatgtgattatcactgtcgtctttagnggtggggcgtggctagtttgggtgttcgggcgggtacggaccgaaacgtcgaccgtctacggtcacgacccgaaggctcgccccctggtccacgttcttcccg

SEQ ID NO: 362676 - DNA, 530 bp, Homo sapiens
  misc_feature: GZ8MTXP02JM3SS.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctcacgcacgctcatctacagtacaaacactcgctcttccggggtccctgatccgcttctctggctccatccttgggaacaaagctgccctcaccatcgacgggggcccaggccagacgatgaatgtagattatcactgtacgtcctttagtgtggggcgtggctagtttgggtgttcggcggtacgggaccaaacgtcgaccgtctacggtcagcccaaggctcgccccctggtcactctccg

SEQ ID NO: 362677 - DNA, 546 bp, Homo sapiens
  misc_feature: GZ8MTXP02JNUQY.15.34.D01.1.454.CMB.2.raw
  modified_base (316)..(316): a, c, t, g, unknown or other
  modified_base (407)..(407): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggcccagcctccacgcacgctcatcacagtacaaacnctcgctcgttccggggtccctgactccgcttctctgctccatcctagggaacaaagctgccctcaccatcgacggggcccaggcagacgangaatgtagattatcactgtcgtcctttagtgtggggcgtggctaggtttggtggtcggcggacggaccaaacgtcgaacccgtccgtacggtccacgacccgaacggccgtcgcccccgtcggtccaccgtccttcccg

SEQ ID NO: 362678 - DNA, 571 bp, Homo sapiens
  misc_feature: GZ8MTXP02HK3C3.15.34.D01.1.454.CMB.2.raw
  modified_base (309)..(309): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctcagtctctacttctaactacgccgcctggtaccggcacgaccccaggccagcctccacgcacgctcatctanagtacaacactcgctcgtccggggtccctgactccgcttctcgtggctccatccgttgggaaacaagctcgccctcacccatcgaccggggcccaggcagacgatagaatgtagattatctactgtccttcctttagtcggtggggcgtggcgtaggtttgggtggttcgggacggacgggaaccaaacggtcggaccgttccgtacgggtcacgacccgaacggtcctcggtcccccgtcgggtccacgttcctttccccg

SEQ ID NO: 362679 - DNA, 521 bp, Homo sapiens
  misc_feature: GZ8MTXP02FPE47.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggccagcctccacgcacgctcatctacagtacaaacactcgctcttccggggtccctgatccgcttctctgctccatcctgggaacaaagctgccctcaccatcacgggggcccaggcagacgatgaatgtgattatcactgcgttcctttatgtggggcgtggctagttgggtgtcggcggtagggaccaaagtcggaccgtctaggtcagcccgaaggctcgcccccttggcacgtctccg

SEQ ID NO: 362680 - DNA, 541 bp, Homo sapiens
  misc_feature: GZ8MTXP02GOIWE.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtcctgactccgcttctctcggctccatccgttgggaacaaacgctgccctcaccatcgaccggggcccaggcagacgatgaatgtagattatcactcgtcgttcctttagtggtggggcgtggcgtagtttgggtgttcgggcggtacgggaccaagtcgaccgtctacggtacagcccgtaaggcctcgccccgtcggtcacgtcttccg

SEQ ID NO: 362681 - DNA, 554 bp, Homo sapiens
  misc_feature: GZ8MTXP02FMAI4.15.34.D01.1.454.CMB.2.raw
  modified_base (346)..(346): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacactcgctcttccggggtccctgatccgcttcnctggctccatcctgggaacaaagcctgccctcaccatcgacgggggcccaggcagacgatgaatgtgattatcactgcgtcctttagtgtggggcgtggctagtttggggtgtttcgggacgggtacgggaccgaaacgtcggaaccggtccgtacggtacgacgacccgaaggcctacgcccccgtcggtcctaccgtccttccccg

SEQ ID NO: 362682 - DNA, 583 bp, Homo sapiens
  misc_feature: GZ8MTXP02HA98K.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtaacaaacactcgctccgttccggggtccctggactcccgcttctctggctccatcccgttagggaaacaaagcctacgcccctacacccacgtccgaccgggggcccaggcaagacgagtgaatgtagattatcacgtgtccgttccgtttagtggtggggtcgtggtcgtaggtttggggtgttcgggcgggtaacgggaaccaaacgtcgtaccgtccgtacggtcacgacccgaaggcctccgtacccccgtcggcctaccgtcgttcccg

SEQ ID NO: 362683 - DNA, 548 bp, Homo sapiens
  misc_feature: GZ8MTXP02GIM82.15.34.D01.1.454.CMB.2.raw
  modified_base (315)..(315): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactcgccgcctggtaccggcacgaccccaggccagccctccacgcacgctcatctacagtacaaacnctcgctcgttccggggtcctgactccgcttctctgctccatcccgtagggaacaagctcgccctcaccatccgaccgggggcccaggcagacgatgaatgtagattatctactgtcgttcctttagtcggtgggcgtggtctagtttgggtgttcgggcggtacggaccaaacgtcgaccgtcgtacggtcacgcccgaaggtcctcgccccctacggtccacgttcctcccg

SEQ ID NO: 362684 - DNA, 523 bp, Homo sapiens
  misc_feature: GZ8MTXP02FGHWI.15.34.D01.1.454.CMB.2.raw
  modified_base (433)..(433): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaaacactcgctcttccggggccctgatccgcttctctggctccatcctgggaacaaagctgccctcaccatcacgggggccccaggcagacgatgaatgtgattatcactgcgtcctttangtggggcgtggcagtttgggtgttcgggcggaggggaccaaactgaccgtctaggtcagcccaaggctcgccccctcggtcacgtctccg

SEQ ID NO: 362685 - DNA, 549 bp, Homo sapiens
  misc_feature: GZ8MTXP02HDY00.15.34.D01.1.454.CMB.2.raw
  modified_base (423)..(423): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcctccggggtccctgactccgcttctctgctccatccttagggaacaaagctcgccctcaccatcgaccgggggcccagggcagacgatagaatgtagattanctactgtacgtcctttagtggtggggcgtggctagttgggtgttcgggcgggtacggaccgaaagtcgaaccgtcgtacgtccacgtacccaaggccgtccgccccctcggtccaccgtcttcccg

SEQ ID NO: 362686 - DNA, 538 bp, Homo sapiens
  misc_feature: GZ8MTXP02FOXHP.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggcctgatccgcttctctggctccatccgtagggaacaaagctgccctcaccatcgacgggggcccaggcagacgatgaatgagattatcactgcgttcctttatggtggggcgtggctagtttggggtgttcgggcggacggggaccaaacgtcgaccgtcgtacggtccagacccaaggcctcgccccctcggtcctacctcttcccg

SEQ ID NO: 362687 - DNA, 549 bp, Homo sapiens
  misc_feature: GZ8MTXP02GKLCQ.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggtccctgactccgcttctctggctccatccttagggaaacaaagctcgccctcaccatcgaccggggcccaggcagacgatgaatgtagattatcactgtcgttccttagtggtgggcgtggctagtttgggtgttcgggcggtacgggaccaaacgtcgaaccgtctacgggtcacggacccaaggcctcgcccccgtcggtcctaccgtctttcccg

SEQ ID NO: 362688 - DNA, 571 bp, Homo sapiens
  misc_feature: GZ8MTXP02G529F.15.34.D01.1.454.CMB.2.raw
  modified_base (321)..(321): a, c, t, g, unknown or other
  modified_base (432)..(432): a, c, t, g, unknown or other
  modified_base (437)..(437): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatctacagtaacaaacnctcgctccgttccggggtcctgactcccgtcttctctggcctccatccgtagggaaacaacgctcgccctcaccacgtccgaccggggcccaggctagacagtgaatgtanattanctactcgtcgttctttagtggtgggtcgtggcgttaggtttgggtcggttcgggacgggtaacgggacctaaagtcgaaccgtcgtacggtccacgcccgaagcctccgtccccgtagtcctacgtccttcccg

SEQ ID NO: 362689 - DNA, 598 bp, Homo sapiens
  misc_feature: GZ8MTXP02H8PA9.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctcagtctctacttctaactacgccgcctggtaccggcacgaccccaggccagcctccaccgcacgctcatctacagtaacaaacactcgctcgttcccggggtccctgactcccgcttctctcggctccatccttagggaaacaaagctcgcccctacaccactcgaccgggggcccaggcagacgatagaatgtgattatcacgtgtccgttcctttagtcgggttggggcgtgggtcgtaggttttcggggtgtttcggggacgggtacggggaaccctaaacggtcgaaacccggttccgtaacggtccacggaccccgaagggcctccggtcccccgtcggtacctaccgtccgttccccg

SEQ ID NO: 362690 - DNA, 543 bp, Homo sapiens
  misc_feature: GZ8MTXP02F0DZ0.15.34.D01.1.454.CMB.2.raw
  modified_base (375)..(375): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtccctgatccgcttctctgctccatccttgggaacaaagctgccctnaccatcgacgggggcccaggcagacgatgaatgtagattagtcactgcgttccctttagtgtgggcgtgggctagtttgggtgttcgggcggtagggaccaaacgtcggtaccgtccgtacggtccgaacgcccgaaggcctcgcccccgtcggtcctactcttcccg

SEQ ID NO: 362691 - DNA, 548 bp, Homo sapiens
  misc_feature: GZ8MTXP02IPV7N.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtgccttgaggtctggctcagtctctacttctaactacgccgcctggaccggcacgaccccaggccacgccctccacgcacgctcatctacagtaacaaacactcgctcgttccgggtcctgactccgcttctctggctccactccgttagggaaacaaagctcgccctcaccactcgaccggggcccaggcagacatgaatgtgattatcactgtcgttctttagtggtggggtcgtggcgtaggtttgggtgttcgggcggacgggaccaaacgtcgaccgtcgtacgtcgacgaccgaacggcctccgcccccgtgtccgtactctcccg

SEQ ID NO: 362692 - DNA, 547 bp, Homo sapiens
  misc_feature: GZ8MTXP02I07E9.15.34.D01.1.454.CMB.2.raw
  modified_base (424)..(424): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagccctccacgcacgctcatctacagtacaaacactcgctctccggggtccctgactccgcttctctgctccatccgttagggaaacaaagctcgccctcaccatccgacggggcccaggcagacgatgaatgtagattancacgtcgtcgttcctttagtggtcgggcgtggcgtagtttgggtgttcgggacggtacggaccaaacgtcggaccgtcgtacggtcacgcccaacggctccgccccgtcggtccactctcccg

SEQ ID NO: 362693 - DNA, 540 bp, Homo sapiens
  misc_feature: GZ8MTXP02F19CC.15.34.D01.1.454.CMB.2.raw
  modified_base (382)..(382): a, c, t, g, unknown or other
  modified_base (471)..(471): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctggatcccgcttctctggctccatccttgggaacaaagctagccctnaccatcaccgggggcccaggcagacgatagaaatgtagattatcactgcgtcctttatgtggggcgtggctagtttgggtgtttcgggnggacgggaccaaaagtcgaaccgtcgtacggtcaggcccaaggctcgcccccgtcggtccactctcccg

SEQ ID NO: 362694 - DNA, 576 bp, Homo sapiens
  misc_feature: GZ8MTXP02GT7FV.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgctcggtaccggcacgaccccaggccacgcctccacgcacgctcatctacagtacaaacactcgcttcgtccggggtcctgactccgtcttctctcgctccatccgttagggaaacaagcctacgccctcaccactcgaccggggccaggcagacgatgaatgtagattatcactgtcgttcctttagttggtcgggcggtggtcgtaggtttgggtggttcgggacgggtaacgggaacctaaacgtaaccgtcgtaacggtccgacgacccgaacggccgtaccgtcccccgtcggtccacctctcccgttcccccg

SEQ ID NO: 362695 - DNA, 551 bp, Homo sapiens
  misc_feature: GZ8MTXP02HBI39.15.34.D01.1.454.CMB.2.raw
  modified_base (415)..(415): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagccctccacgcacgctcatctacagtacaaacactcgctcgtccggggtccctgatcccgcttctctgctccatccgttagggaacaaagctcgccctcaccatcgaccggggcccaggcagacgatgaatgngattatcactgtcgttcctttagtggtggggcgtggcgtagtttgggtgttcgggcggtacggggaccaaacgtcgacccgtcgtacggtcacgcccgaaggcctccggccccctcggtccaccgtccgttccccg

SEQ ID NO: 362696 - DNA, 575 bp, Homo sapiens
  misc_feature: GZ8MTXP02HDCBO.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacactcgctcgttccggggtcctgactccgcttctctggctccatccgttagggaaacaaacgctcgccctcaccactcgaccgggggcccaggcagacgactgaatgtagtattatcactcgtcgttcctttagtggtcggggcgtggcgtaggtttgggtggtcgggacggtacgggaccgaacgtcgaccggtactacggtccacggacccgaacggtcctccgcccccgttcggtccctaccgtccgttccccgg

SEQ ID NO: 362697 - DNA, 581 bp, Homo sapiens
  misc_feature: GZ8MTXP02G42XH.15.34.D01.1.454.CMB.2.raw
  modified_base (429)..(429): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgcccgcctggtaccgcacgaccccaggccagcctccacgcacgctcatctacagtacaaacactcgctcgtccggggtccctgactccgcttctctcgctccatccgttgggaaacaaagctacgccctcacccatcgaccgggggcccaggcagacgatagaatgtgattancactcgtcgttccttagtggtcggggtcgtcggtctaggtttgggtcggttcgggacggtacgggaacccaaacgtcggaccgttcgtacggtacaccggaccgtaacggccgtcccgtcccccgtcggtacctaccgttcgtttcccccgg

SEQ ID NO: 362698 - DNA, 558 bp, Homo sapiens
  misc_feature: GZ8MTXP02H4WGZ.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagcctccacgcacgctcatctacagtacaaacactcgctcgttcccggggtcctgactccgcttctctggctccactccgttagggaaacaagcctcgcccctcacccatccgacgggggcccaggcagacgatgaatgtgattatcactcgtcgttcctttagtggtggggtcgtggcgtaggtttgggtggttcgggacggtacgggaacctaaacgtcggaccgtcgtacgcacgcccgaaggcctcgcccctcggtccacttccgtcccg

SEQ ID NO: 362699 - DNA, 548 bp, Homo sapiens
  misc_feature: GZ8MTXP02G1C9N.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcagaccccaggccagcctccacgcacgctcatctacagtacaaacactcgctccttccggggtcctgatccgcttctctggctccatccgttagggaacaaagctcgcccttaccatcgacggggcccaggcagacgatcgaaatgtagattatcactgcgttccttagtggtggggcgtggcgtagtttcgggtgttcgggcggacgggaccaaagtcgaccgtcgtacggtcacgcccgaaggcctcgcccccgtcggtcaccgtctcgttaccccc

SEQ ID NO: 362700 - DNA, 593 bp, Homo sapiens
  misc_feature: GZ8MTXP02JU5VH.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccacgccctccacgcacgctcatctacagtacaacactcgctcgtccggggtcctgactccgcttctctcggtctccatccgttagggaaacaaacgctcgccctcacccatccgaccgggggcccaggcagacgatagaagtgtagtattacgtctacgtcgtcgttacctttagtgggtcggggtcgtgggtcgttagtttggggttggttcggggacggggtacgggaacccgtaaagtccggtacccggtcgtacggtcaccggacccgtaacgccgtaccgcccccgtcggtccctacgtccgtccccg

SEQ ID NO: 362701 - DNA, 594 bp, Homo sapiens
  misc_feature: GZ8MTXP02J0MSG.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtaacaaacactcgctcgttccggggtccctgatcccgcttctctcggctccatccgttagggaaacaaagctcgcccctcacccatccgaccgggggcccagggacagacgatagaaagtgtagtattagtcactcgcgttcctttagtgggtggggtcgtgggccgttaggtttggggttcgttcggggcgggacgggaacctaaacgtcggtaacccgtccgtacggtaccacggacccgaacggcctaccggcccccgttcggtctacccgttcttccccg

SEQ ID NO: 362702 - DNA, 549 bp, Homo sapiens
  misc_feature: GZ8MTXP02HFXXP.15.34.D01.1.454.CMB.2.raw
  modified_base (304)..(304): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagcctccacgcacgctcatctanagtacaaacactcgctcttccggggtccctgatccgcttctctggctccgatccgttgggaaacaaaggctcgcccctcacccactcgaccgggggcccaggcacgacgagtgaatgtagtattaatcactgtcgtcctttagtggtggggcgtggcgtagtttgggtgttcgggcggacggaccgaaacgtcgaccgtccgtacggtcacgcccaaggctccgcccctcggtcactccgtcccg

SEQ ID NO: 362703 - DNA, 646 bp, Homo sapiens
  misc_feature: GZ8MTXP02IWGEO.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacactcgctcgttcccggggtcctgatcccgcttctctgctccatccgttagggaaacaaacgctcgccctcaccactccgaccggggcccaggcagacgatagaatgtagaattactactactcgtccgttaccttttagtgggtcggggtcgtggtacgttaggtttgggggttcggtttcggggacggggaacggggtaacccgtaaaaccggttcgggtaaacccggttcccggtaacggttacccgaaccggacccccggtaaacggggtcccttacccccgggtccccccgttccggttaccctaacccgtttccgtttacccccgg

SEQ ID NO: 362704 - DNA, 563 bp, Homo sapiens
  misc_feature: GZ8MTXP02GV3L3.15.34.D01.1.454.CMB.2.raw
  modified_base (410)..(410): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctccgttccggggtcctgactccgcttctctgctccatcctagggaacaaagctcgccctcaccactcgaccgggggcccaggcagacgangaatgtagattatctactcgtacgttcctttagtcggtggggcgtggtcgtaggtttgggtggttcgggcgggtacgggaaccaaacgtcggaccgttcgtacggtccgacgaccgaacggtcctcggcccccgtcggtcctactccttcccg

SEQ ID NO: 362705 - DNA, 539 bp, Homo sapiens
  misc_feature: GZ8MTXP02GR1I8.15.34.D01.1.454.CMB.2.raw
tcagtctacgtagccacgaccggtgctcgatttagatcgtctgtgttgggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctctccggggtccctgatccgcttctctggctccatccttagggaacaaagctcgccctcaccatcgacgggggcccaggcagacgatgaatgtgattatcactgtccgttcctttagtggtggggcgtggctagtttggggtgttcgggacggtagggaccaaacgtcggaccgtcgtacggtcagcccaaggctcgccccctggtccacgtcgttccg

SEQ ID NO: 362706 - DNA, 558 bp, Homo sapiens
  misc_feature: GZ8MTXP02JWP3S.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgacccccaggcccagccctccacgcacgctcatctaacagtacaaaacactcgctcgttccggggtccctgatcccgcttctctggctccatccgttagggaaacaaagctcgccctcaccatccgaccgggggcccaggcagacgatagaatgtagtattatcactgccgttctttagtggtgggcgtggcgtagttgggtgttcgggcggtacgggaccaaacgtcgtaccgtccgtacggccacgcccgaaggcctccgccccgtcggtccacgtctcccg

SEQ ID NO: 362707 - DNA, 541 bp, Homo sapiens
  misc_feature: GZ8MTXP02GF0X6.15.34.D01.1.454.CMB.2.raw
  modified_base (471)..(471): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacactcgctcttccggggtcctgatccgcttctctggctccatccttagggaacaaagctcgccctcaccatcgacgggggcccaggcagacgatgaatgtagattatcactgtcgttcctttagtgtggggcgtggctagtttgggtgttcggngggacggaccaaacgtcgaccggtcgtacgtcacgcccgaaggcctcgccccctcggtcacgtcttcccg

SEQ ID NO: 362708 - DNA, 566 bp, Homo sapiens
  misc_feature: GZ8MTXP02IOXJ7.15.34.D01.1.454.CMB.2.raw
  modified_base (318)..(318): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggaccggcacgaccccaggccacgcctccacgcacgctcatctacagtacaaacnctcgctcgtccgggtcctgactccgcttctctcgctccatccgttaggaaacaagctcgccctcaccatcgacggggccaggcagacgatagaatgtagtattatctactcgtcgttcctttagtggtgggtcggtggctaggtttgggtcgttcggggacggacgggaaccaaacgtcgaccggttaccgtacggtaccgacgacccgaacggcctaccgcccccgtcggtcctaccgttcctcccg

SEQ ID NO: 362709 - DNA, 553 bp, Homo sapiens
  misc_feature: GZ8MTXP02F9J8U.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctctccggggtccctgactccgcttctctcggctccactccttgggaaacaaagctcgccctcaccatcgaccggggcccaggcagacgatagaatgtagattatcactgtcgttcctttagtggtggggcgtggcgtagtttgggtgttcgggcggacggaccaaacgtcgaccgtccgtacggtccgagacccgaaggcctccgcccccgtcggtccaccgtcttacccg

SEQ ID NO: 362710 - DNA, 535 bp, Homo sapiens
  misc_feature: GZ8MTXP02HVGMR.15.34.D01.1.454.CMB.2.raw
  modified_base (453)..(453): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctcgtccggggtccctgactccgcttctctggctccatccttggaacaagctgccctcaccatcgacgggggcccaggcagacgatgaatgtagattatctactgtcgttcctttagtcggtggggcgtggngtgtttggggtgttcgggcggacgggaaccaaagtcgaccgtctaggtcacgccaaggcctcgacccctgtccactctcccg

SEQ ID NO: 362711 - DNA, 583 bp, Homo sapiens
  misc_feature: GZ8MTXP02HT34Z.15.34.D01.1.454.CMB.2.raw
  modified_base (340)..(340): a, c, t, g, unknown or other
  modified_base (392)..(392): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctcacgcacgctcatctaacagtaacaaacactcgctcgtccggggtcccngatcccgcttctctcgctccatccgttagggaaacaaagctcgccctcaccntcgaccggggcccaggcaagacgatagaatggtatattatctacttcgtcgttcctttagtggtggggcgttggctaggtttgggtgttcgggacggacgggaacctaaacggtcgaccggttcgtaacggtcgaacgacccgaaggtcctacccggtcccccgtacggtaccacgtttccgtttaccccg

SEQ ID NO: 362712 - DNA, 543 bp, Homo sapiens
  misc_feature: GZ8MTXP02GVR8M.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcgttccggggtccctgactccgcttctctggctccatccttgggaaacaaagctcgccctcaccatccgacggggcccaggcagacgatgaaatgtagattactcactgtccgttactttagtggtggggcgtggcgtagtttgggtgttcgggcgggacggaccaaagtcgaccgtcgtacgtcgagcccgaagctcgcccccgtggccactcttcccg

SEQ ID NO: 362713 - DNA, 586 bp, Homo sapiens
  misc_feature: GZ8MTXP02HNQZP.15.34.D01.1.454.CMB.2.raw
  modified_base (428)..(428): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgacccccaggcccagccctccacgcacgctcatctacagtacaaacactcgctcgtccggggtccctgactccgcttctctggctccatcctgggaaacaaagctcgccctcaccactcgaccggggcccaggcagacgatgaatgtagattanctactgtcgttcctttagtggtgggggcgttgggcgttaggtttggggtcggtttcggggcgggtaacggggaccaaaacgtcggtacccgttccgtacgggtccaacggcccgaacgggcctcccggcccccgtcggtccaccgttcgttcccccgg

SEQ ID NO: 362714 - DNA, 563 bp, Homo sapiens
  misc_feature: GZ8MTXP02HX6Z4.15.34.D01.1.454.CMB.2.raw
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctccgttccggggtccctgatccgctttctctggctccatccgttagggaaacaaagcctacgcccctcacccagtccgaccgggggcccaggccagacgatgaatgtgaattatcacttgtccgttcctttagtggtcggggcgtggtcgtagtttgggtggttcgggcggacgggaccaaacgtcgaccgtcgtacgtcacgccgaacggctccgcccccgtcgtcctacgtcctcccg

SEQ ID NO: 362715 - DNA, 567 bp, Homo sapiens
  misc_feature: GZ8MTXP02FJXS5.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatccgcttctctcggctccatccgtagggaaacaaagcctcgcccctcacccatccgacgggggcccaggcagacgatgaatgtagattatcactgtcgttcctttagtggtggggtcgtggtcgtagtttggggtggttcgggcgggacgggaccgaaacgtcggacccgtccgtacggtaccgacgacccgaaggtcctccgcccccgtcggtccacctcgttcccg

SEQ ID NO: 362716 - DNA, 568 bp, Homo sapiens
  misc_feature: GZ8MTXP02HSDLR.15.34.D01.1.454.CMB.2.raw
  modified_base (355)..(355): a, c, t, g, unknown or other
  modified_base (363)..(363): a, c, t, g, unknown or other
  modified_base (434)..(434): a, c, t, g, unknown or other
tcagtctacgtagccacgaccggtgctcgatttagatcgtctgtgttgggtttggggggaagcctgagaacacttagccttcattgagtgtccccaccatggcctggatgatgcttctcctcggactccttgcttatggatcaggagtggattctcagactgtggtgacccaggagccatcgttctcagtcgtcccctggagggacagtcacactcacttgtgccttggaggtctggctcagtctctacttctaactacgccgctggtaccggcacgaccccaggccacgccctccacgcacgctcatctacagtaacaaacactcgctcgttccggggtcctgactccgcttcnctgctccntccgttagggaacaagcctcgccctcacccatcgaccggggcccaggcagacgatcgaagtgtagtattanctactcgtacgttctttagtggtcggggtcgtggtcgttaggtttgggttggtcgggacggacggaaccgtaacgtcgtaccgtcgtacgtcgacgaccgaacgcgtccgtcccgtcgtcctacttccgtcccg

SEQ ID NO: 362717 - DNA, 530 bp, Homo sapiens
  misc_feature: GZ8MTXP02I32AD.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctggctccatccttgggaacaaagcctgccctcaccatcgacggggcccaggcagacgatgaatgtagattatcactgtcgttcctttagtgtggggcgtggctagtttgggtgttcggcggacggaccaaactcgaccgtcgtacggtccagcccaaggctcgcccctcggtccactctccg

SEQ ID NO: 362718 - DNA, 573 bp, Homo sapiens
  misc_feature: GZ8MTXP02GL5P2.15.34.D01.1.454.CMB.2.raw
  modified_base (317)..(317): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagcctccacgcacgctcatctacagtaacaaacnctcgcttccgtccggggtcctgactccgcttctctcgctccatccgtagggaacaagctcgccctcaccatccgaccggggcccaggcagacgatgaatgtagtattatcacttcgtccttcgtttacgtgggtcggggcgtggcgttagttgggtggttcgggcgggtacggaaccgtaacgtacgacccgttacgtacgtacaccggaccgaacggccgtccgtcccccgtcggtcctaccgttccgtccccgg

SEQ ID NO: 362719 - DNA, 533 bp, Homo sapiens
  misc_feature: GZ8MTXP02FH1OA.15.34.D01.1.454.CMB.2.raw
  modified_base (346)..(346): a, c, t, g, unknown or other
  modified_base (419)..(419): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcagaccccaggccagcctccacgcacgctcatctacagtacaaaacactcgctcttccggggtcctgatccgcttcnctggctccatcctgggaacaaagctgccctcaccatcgaccgggggcccaggcagacgatgaatgtagattancactgcgttccttatgtggggcgtggctagttgggtgttcgggcggtacgggaccaaacgtcgaccgtctacggtcacgcccgaaggcctcgccccctcggtccactcttcccg

SEQ ID NO: 362720 - DNA, 537 bp, Homo sapiens
  misc_feature: GZ8MTXP02HEAH7.15.34.D01.1.454.CMB.2.raw
  modified_base (424)..(424): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacactcgctccgttccggggtccctgactccgcttctctgctccatcctagggaacaaagctcgccctcaccatcgacggggctcgaggcagacgatagaatgtagattanctactgcgttccttagtcggtggggtcgtggctagttgggtgttcggcggagggaccaaacgtcgaccgtcgtacgtcacgccgaacggcctcgccccgtcggtccactcccg

SEQ ID NO: 362721 - DNA, 543 bp, Homo sapiens
  misc_feature: GZ8MTXP02IB171.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctcagtctctacttctaactacgccgcctggtaccggcacgaccccaggccagcctccacgcacgctcatctacagtacaaacactcgctcttccggggtcctgactccgccttctctcggctccattccttagggaaacaaacgctcgccctcacccactcgacgggggcccaggcagacgatgaatgtgatatcactgtcgttcctttatggtcggggcgtggctagtttgggtgttcggcggacgggaccaacgtcgaccgtctacgtcgacgccgaacggctcgcccctcggtccactctcccg

SEQ ID NO: 362722 - DNA, 576 bp, Homo sapiens
  misc_feature: GZ8MTXP02G08KW.15.34.D01.1.454.CMB.2.raw
  modified_base (467)..(467): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagccctccaccgcaccgctcatcacagtacaaacactcgctccttccggggtccctgatcccgtcttcctcgtcggcctccattcccgttagggaaacaaagcctcgcccctcacccatccgaaccgggggcccaggcagacgagtagaatgtagacttatcctagtcgtcgttacctttagnggtcggggtcgtggtctaggtttgggtcgttcgggcggacggaccaaacgtcgaccgtcgtacgtacgacgcccgaaggcctaccgtccccctcggtccactcttcccg

SEQ ID NO: 362723 - DNA, 574 bp, Homo sapiens
  misc_feature: GZ8MTXP02J04Y5.15.34.D01.1.454.CMB.2.raw
  modified_base (320)..(320): a, c, t, g, unknown or other
  modified_base (430)..(430): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgcccgccgtggtacccggcacgaccccaggccagcccctccacgcacgctcatctacagtacaaacnctcgctcgttccggggtccctgatccgcttctctgctccatcccgtgggaaacaagctcgccctcaccactccgacgggggcccaggcagacgatagaatgagtattacnctacgtcgtccgttaccgtttagtgggtggggccgttaggcgttaggttgggtgtcgggtcgggacggacctaaacgcggtaccgtccgtaggtccgacgacccaaggtcccgtcgcccccgttcggcctacctcgtttccccg

SEQ ID NO: 362724 - DNA, 569 bp, Homo sapiens
  misc_feature: GZ8MTXP02JHSZJ.15.34.D01.1.454.CMB.2.raw
  modified_base (526)..(526): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgccctccacgcacgctcatctacagtaacaaacactcgctccgttccggggtccctggactcccgcttctctcggctccatccgttgggaaacaaagcctcgcccctcacccatccgaccgggggcccaggcagacgatgaatgtagattatcactcgtccttctttagtggtggggcgtggctggtttggggtgttcgggacgggacggaccaaacggtcgaccgtacgtacgtaccncgacccgaagccgtccgtccccctcggtccaccgtccttcccg

SEQ ID NO: 362725 - DNA, 585 bp, Homo sapiens
  misc_feature: GZ8MTXP02GK6KN.15.34.D01.1.454.CMB.2.raw
  modified_base (425)..(425): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgcctggtaccgcacgaccccaggccagcctccacgcacgctcatctacagtacaaacactcgctcgtccgggtcctgactccgcttctctcggctccatccgtagggaaacaagctcgccctcaccatcgaccggggcccaggcagacgatgaatgtacgtattanctactcgtcgttcctttagtggtggggtcgtggtcgttaggtttggggtcggttcgggacgggtaacgggacccgtaaacgtcgtacccggtacgttacggaccacggtacccgaacggtccgtaccgtcccccgtacggtcctaccgtccgtttccccg

SEQ ID NO: 362726 - DNA, 632 bp, Homo sapiens
  misc_feature: GZ8MTXP02JX76R.15.34.D01.1.454.CMB.2.raw
  modified_base (325)..(325): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtcgccttggaggtctggctcagtcctcttacttctaaactccgccgccgtcggaccggcacgaccccaggccacgcctccacgcacgctcactcacagtaacaaaacnctcgctcgttcccggggtcctgatcccgtcttctcgtcggcctcctactccgttaagggaaaccaaacgtcctccgcccctacacccacgtccggacccgggggcccacggccaaggacgagagtaagttggtataacttactacgtacgtcgtcgttaccgtttagtcgggtggggtcggtggtcgttaggtttggggttacggtcgggacgggtaacgggtaacctaacggtccggtaccgtacggtacggtcaccgaccgaacggtcccgtaccgtccccgtcggtacctccgttccgttcccg

SEQ ID NO: 362727 - DNA, 588 bp, Homo sapiens
  misc_feature: GZ8MTXP02JXM89.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacactcgctcgttccggggtcctgactccgcttctctcggctccatccgttagggaaacaaagctgcccctacaccactcgaccgggggcccaggcagacgatgaatgtagtattatctacgtcgtcgttcctttagtggtggggcggtggtcgtagtttggggtggttcggggacggacgggaccgaaacgtcggacccggttccgtacggtccaccggacccgtaacggcccgtccgcccccgtcggtccctaccgttccgtttccccgg

SEQ ID NO: 362728 - DNA, 540 bp, Homo sapiens
  misc_feature: GZ8MTXP02GXKM1.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacactcgctcttccggggtcctgatccgcttctctgctccatccgttgggaacaaagctcgccctcaccatcgacggggcccaggcagacatatgtgatatcactgcgttctttatcggtggggcgtggctagtttgggtgttcggcgggaggaccaaacgtgaccgtcgtacggtcacgacccgaaggccgtcgcccccgtcggtccacctcctcgttcccccg

SEQ ID NO: 362729 - DNA, 625 bp, Homo sapiens
  misc_feature: GZ8MTXP02HOFIG.15.34.D01.1.454.CMB.2.raw
  modified_base (314)..(314): a, c, t, g, unknown or other
  modified_base (325)..(325): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactaccgccgcctcggtaccggcacgacccccaggccagccctccacgcacgctcatctanagtaacaaacnctcgctcgttcccggggtcctgactcccgcttctctggctccatccgtagggaaacaagctcgccctcaccatcgaccggggccaggcagacgatgaatgtagattactctacgttcgtacgttccgtttagtgggttcgggggtcggtcgggtcgtaggtttgggggttcggttacggggacggggtaacgggaacccgtaaacggtacggtaacccgttccggtaacggtccgaaccgacccggaacggcccgtacccggtacccccgtcgggtccctaccgtttcccgtttccccgg

SEQ ID NO: 362730 - DNA, 596 bp, Homo sapiens
  misc_feature: GZ8MTXP02FYS70.15.34.D01.1.454.CMB.2.raw
  modified_base (319)..(319): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctcgttccggggtcctgactcccgcttctctggctccatccgtagggaaacaagcctcgccctcaccatcgaccggggcccaggcagacgatagaatgtagtattactctactcgtccgttcctttagtcgttaggcgggtcgtgggtcgttaggtttgggggtcggttcggggacgggtaacgggaacctaaacggtcggtaacccgttccgtaacggtcaaccggaacccgaacggccgtcccggcccccgtacggtcctaccgtttcccg

SEQ ID NO: 362731 - DNA, 593 bp, Homo sapiens
  misc_feature: GZ8MTXP02JXCTZ.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgcccgcctggtaccggcacgaccccaggcccagccctccacgcacgctcatctacagtaacaacactcgctcgtccggggtcctgatcccgcttctcgtgctccatccgtagggaaacaaacgctacgcccctcaccacgtccgaccgggggcccaggcacgacgatagaatgtagtaattagctacgtcgtacgtttcctttagtgggtgggtcggtggtcgtaggtttcgggtcggtttcgggacgggtacggaaccgtaaacgtccgtaccgtccgtacggtaccacgtacccgaaggccctccggcccccgtcggtcctccgtcttccccgg

SEQ ID NO: 362732 - DNA, 533 bp, Homo sapiens
  misc_feature: GZ8MTXP02I58DU.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagcctccacgcacgctcatctacagtacaaacactcgctcttccggggtccctgatccgcttctctgctccatccttgggaacaaagctcgcccttacactcgacggggcccaggcagacgatgaatgtgattatcactgcgttcctttagtggtgggcgtggctagtttgggtgttcggcggacggaccaacgtcgaccgtctacggtcacgcccaggcctcgcccctcggtcactctcgttcccc

SEQ ID NO: 362733 - DNA, 567 bp, Homo sapiens
  misc_feature: GZ8MTXP02GU59G.15.34.D01.1.454.CMB.2.raw
  modified_base (451)..(451): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtaccggcacgaccccaggccacgcctccacgcacgctcatcacagtaacaaacactcgctcgtccggggtccctgactcccgtcttctctcggctccatccgtagggaaacaaagctcgcccctcaccatccgaccggggcccaggcagacgatgaatgtagattatcgactgtcgttcctttaggnggtcggggcgtggtctaggtttggggtcggttcgggacggacgggaaccaaacgtcggaccgtcgtacggtcgacgacccgaaggcctccgccccgtcggtccacgttccgtcccg

SEQ ID NO: 362734 - DNA, 602 bp, Homo sapiens
  misc_feature: GZ8MTXP02JBND2.15.34.D01.1.454.CMB.2.raw
  modified_base (411)..(411): a, c, t, g, unknown or other
  modified_base (423)..(423): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctcgttccggggtccctgactccgcttctctggctccatccgttagggaacaaagcctcgccctcaccatcgaccggggcccaggcagacgangaatgagattanctactgtcgttcctttagcggtgggcgtggtcgtagtttggggtcggtttcggacgggtaacgggtaccctaaacggtcggtaccccgttaccgtaacgggttaccaaccggaccccgaaagggtcccgtacccggtccccccgttacgggtacccttacccgttccgtttccccccgg

SEQ ID NO: 362735 - DNA, 575 bp, Homo sapiens
  misc_feature: GZ8MTXP02IRFZ9.15.34.D01.1.454.CMB.2.raw
  modified_base (282)..(282): a, c, t, g, unknown or other
  modified_base (292)..(292): a, c, t, g, unknown or other
  modified_base (318)..(318): a, c, t, g, unknown or other
  modified_base (322)..(322): a, c, t, g, unknown or other
  modified_base (338)..(338): a, c, t, g, unknown or other
  modified_base (346)..(346): a, c, t, g, unknown or other
  modified_base (375)..(375): a, c, t, g, unknown or other
  modified_base (403)..(403): a, c, t, g, unknown or other
  modified_base (418)..(418): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccgtggaggacagtcacactcacttgtcgtccttggaggttctggtctcagttctctacttctaactacgccgcgtcggaccgcacgacccnggccacgccnccacgcacgctcatcacataacaacnctcnctccgtccggcctgcnccgtctcncgtcgctcatcgtaggaacacgctcgccncacgacgtcgaccgggccaggcagacanagtatgtagtattancgtactcgtcttacgttgggtgggtgggttcgtggtacgttaggtttcggggtacggttcggggacgggtaacggaccgtaacgtaccggtaccgttacgtacggacgaccggaccgtaacgccgttcccgcccgtacgtcctccgttcctaccccg

SEQ ID NO: 362736 - DNA, 537 bp, Homo sapiens
  misc_feature: GZ8MTXP02F7MA2.15.34.D01.1.454.CMB.2.raw
  modified_base (345)..(345): a, c, t, g, unknown or other
  modified_base (421)..(421): a, c, t, g, unknown or other
  modified_base (435)..(435): a, c, t, g, unknown or other
  modified_base (454)..(454): a, c, t, g, unknown or other
  modified_base (525)..(525): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcttccggggcctgatccgcttcnctggctccatcccgtagggaaacaaagctcgccctcaccatcgacgggggcccaggcagacgatgaatgagattancatgcgtctttagngtgggcgtgctagttgggngttcggcggacggaccaacgtcgaaccgtcgtacgtaccacgacccgaaggctccggcccccgtcggtccncctcgttccccg

SEQ ID NO: 362737 - DNA, 539 bp, Homo sapiens
  misc_feature: GZ8MTXP02GB9KT.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctctccggggtcctgatccgcttctctggctccatcctgggaacaaagctcgccctcaccatccgacggggcccaggcagacgatgaatgtgattatcactgcgttcctttagtgtggggcgtgggctagtttgggtgttcgggcggacgggaccaaacgtcgaccgttcgtacggtccgacgacccgaaggctccgcccccgtcggtcacctcttcccg

SEQ ID NO: 362738 - DNA, 596 bp, Homo sapiens
  misc_feature: GZ8MTXP02GXPU9.15.34.D01.1.454.CMB.2.raw
  modified_base (472)..(472): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtcgccttgaggtctggctcagtctctacttctaactcgccgctggtaccggcacgaccccaggccacgcctccacgcacgctcatctacagtaacaacactcgctcgttccggggtcctgatcccgcttctctcggcctccatccgtaggaaacaagcctcgccctacaccagtccgaccgggggcccaggcagacgatagaatgtagtattactctactcgtacgttctttaggtggtcgggtcgtggtnttaggtttcggggtgttcgggacgggtaacggtaacccgtaaacgtcggtaacccgtacgttacgtaccgacgacccgaacggtcctcccggtcccccgtcggtacctaccgttctttcccccg

SEQ ID NO: 362739 - DNA, 605 bp, Homo sapiens
  misc_feature: GZ8MTXP02JBIMI.15.34.D01.1.454.CMB.2.raw
  modified_base (439)..(439): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggacgccatcgttctcagtgtcccctggagggacagtcacactcacttgtgccttgaggtctggctcagtctctacttctaactacgccgcctggtaccgcacgaccccaggccacgccctccacgcacgctcatctacagtacaaacactcgctccgttccggggtcctgactccgcttctctcggcctccatccgttagggaaacaaagcctcgccctcacccagtccgaccggggcccagggcaacgacgatacgaatgagtattacncgtacgtcgtccgttcctttaggtcgggtcggggcgtcgggtacgttggtttggggtcggttcggggacgggtaacgggaaccctaaacgtcggtaaaccgttccgtacgtaccgaccgtacccgaaggtccgtaccgcccccgtaccggtcaccttcgttccccg

SEQ ID NO: 362740 - DNA, 530 bp, Homo sapiens
  misc_feature: GZ8MTXP02IG87Z.15.34.D01.1.454.CMB.2.raw
  modified_base (438)..(438): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagcctccacgcacgctcatctacagtacaaacactcgctcttccggggtcctgatccgcttctctgctccatccgttgggaacaaagctcgccctcaccatcacgggggcccaggcagacgatgaatgtgattatcactgccgttcctttagnggtgggcgtggctagtttgggtgttcggcggagggaccaaagtcgaccgtctacggtacagcccaaggcctcgccccctgtccactctcccg

SEQ ID NO: 362741 - DNA, 597 bp, Homo sapiens
  misc_feature: GZ8MTXP02JRD09.15.34.D01.1.454.CMB.2.raw
  modified_base (438)..(438): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccggcacgaccccaggccacgcctccacgcacgctcatcacagtacaaacactcgcttccgttcccggggtccctggactcccgcttctctggcctccatccgttagggaaacaagcctacgccctcaccatccgaccggggcccaggcagtacgatgaatgtagtattacnctactcggtctttaccgtttagtcggtggggtcgtcggtcgttaggtttggggtcgttcggggacgggtaacgggacctaaacggttcggacccggtcgttacggaccacggacccgaaggtccctccggtcccccgtcggtcctaccgtccttccccg

SEQ ID NO: 362742 - DNA, 529 bp, Homo sapiens
  misc_feature: GZ8MTXP02JT8TI.15.34.D01.1.454.CMB.2.raw
  modified_base (305)..(305): a, c, t, g, unknown or other
  modified_base (422)..(422): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtccctggaggacagtcacactcacttgtgccttgaggtctggctcagtctctacttctaactacgccgcctggtaccggcacggaccccaggccagccctccacgcacgctcatctanagtaacaacactcgctcgttccggggcctgatccgcttctctcgctccatccgtagggaaacaaagctgccctcaccatccgaacggggcccaggccagacgatgaatgtgattatnactgtacgttcctttagtggtcgggcgttggctaggttgggtgttcggcggtacgggaccaaacgcgacgtctacgcacgccaagctccgcccctggccactcgtcc

SEQ ID NO: 362743 - DNA, 742 bp, Homo sapiens
  misc_feature: GZ8MTXP02GRR7X.15.34.D01.1.454.CMB.2.raw
  modified_base (304)..(304): a, c, t, g, unknown or other
  modified_base (324)..(324): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtacccggcacggacccccaggcccacgccctccacgcacnctcatctacagtacaaaacnctcgctccgttccggggtcctggactccgtcttcctcgtacggtcctccacttcccgttaggggaaaacctaaacgtcctccgccccctacaacccgagtcccggacccgggggcccaaggggcctaaggaccgtatagaagttgtagtaacttagtcctacgtcggttacgttaccttttagggtcgggttcgggggtacgttcgggtacgttaacgggttttgggggttacggtttaccgggggaccggggtaaaccggggtaaaccccgttaaacggttacccgggtaacccggttacccgggtttaacggggtacccgtaacccggtacccccggaaacgggttccccgttaacccccggtcccccccggtttaccgggtcccccttaacccgtttcccgttttacccccccgg

SEQ ID NO: 362744 - DNA, 575 bp, Homo sapiens
  misc_feature: GZ8MTXP02JGMY5.15.34.D01.1.454.CMB.2.raw
  modified_base (430)..(430): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctccgttccggggtccctgatcccgcttctctggctccatccgttagggaacaaagctagcccctcaccactccgaccgggggcccaggcagacgatgaatgtacgattancacgtgcgttccgtttagtggtgggggtccgtggtcgtagtttgggttggttcggggacggtaacggggaccaaacgtcgaaccggttccgtaacgggtccacggacccgaaggtcctcggccccctcggtccaccttcgtcccg

SEQ ID NO: 362745 - DNA, 653 bp, Homo sapiens
  misc_feature: GZ8MTXP02G37TG.15.34.D01.1.454.CMB.2.raw
  modified_base (269)..(269): a, c, t, g, unknown or other
  modified_base (277)..(277): a, c, t, g, unknown or other
  modified_base (285)..(285): a, c, t, g, unknown or other
  modified_base (310)..(310): a, c, t, g, unknown or other
  modified_base (331)..(331): a, c, t, g, unknown or other
  modified_base (453)..(453): a, c, t, g, unknown or other
  modified_base (505)..(505): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctgggagggacagtcacactcacttgtcgccttgaggtctggctcagtctcttacttctaactcgccgctggtaccgnacgacccngccagccncacgcacgctcatcacataacaacnctcgcttcgtccggggtcccngtactccgtccttctcgtggtactccgtactccgttagggaaacaaacgccttacgccctacaccacgtaccggaccgggggacccagggaccagacgagtagtaaagtgtagtaatttaanctaccgtcggttaccgttccgtttaaggtcgggtcggggtccggtttcgggngttacggttttggggttacgggttcgggggacgggtaaacggggaaccgtaaacgtttacggacccggttacgtacgggttcccgaacgtacccggaaacggccgttacccggaccccgttcggtacctaccgttccctttaccccgg

SEQ ID NO: 362746 - DNA, 562 bp, Homo sapiens
  misc_feature: GZ8MTXP02GUH6A.15.34.D01.1.454.CMB.2.raw
  modified_base (317)..(317): a, c, t, g, unknown or other
  modified_base (429)..(429): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtaccggcacgaccccaggccagccctccacgcacgctcatcacagtacaaacnctcgctccgttccggggtccctgactcccgtcttctctcggctccacttccgttagggaaactaaacgctacgccctacacccatccgaccgggggcccacggccagacganagaatgtagtattatcactgtcgttctttagtggtgggcgtggctagtttgggtgtcggcggacggacaaacgtcgaccgtcgtacgtcacggtaccaagccgtaccgccccgtcggacctacctcgttcccg

SEQ ID NO: 362747 - DNA, 505 bp, Homo sapiens
  misc_feature: GZ8MTXP02FTE33.15.34.D01.1.454.CMB.2.raw
  modified_base (346)..(346): a, c, t, g, unknown or other
  modified_base (405)..(405): a, c, t, g, unknown or other
  modified_base (412)..(412): a, c, t, g, unknown or other
  modified_base (416)..(416): a, c, t, g, unknown or other
  modified_base (429)..(429): a, c, t, g, unknown or other
  modified_base (434)..(434): a, c, t, g, unknown or other
  modified_base (487)..(487): a, c, t, g, unknown or other
  modified_base (498)..(498): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccgcacgaccccaggccagcctccacgcacgctcatctacagtacaaacactcgctccttccggggcctgatcccgcttcnctgctccatccgtagggaacaaagcctgccctcaccatcgacggggcccaggcagacgntgatganttancatgctctttagngtggngtgcgtgttggtgtcggcgacggacacgtcgacgtacgcgcacgccgaagccncgcccgtcgcnctctccg

SEQ ID NO: 362748 - DNA, 527 bp, Homo sapiens
  misc_feature: GZ8MTXP02JPQ3A.15.34.D01.1.454.CMB.2.raw
  modified_base (408)..(408): a, c, t, g, unknown or other
  modified_base (419)..(419): a, c, t, g, unknown or other
  modified_base (497)..(497): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatcacagtacaaacactcgctcgttccgggtccctgactccgcttctctcggctccatcctagggaactaaagctgccctcaccatcgacggggcccaggcagacgangaatgcgatancactgcgtcctttagtgtggggtcgtggctagtttgggtgttcgggcgggtacgggacaaagtcgaccgtcgtacgcncgaccaagctcgcccctcggcactctcccg

SEQ ID NO: 362749 - DNA, 583 bp, Homo sapiens
  misc_feature: GZ8MTXP02GWDCZ.15.34.D01.1.454.CMB.2.raw
  modified_base (461)..(461): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtccctggagggacagtcacactcacttgtgccttgaggtctggctcagtctctacttctaactacgccgctggtaccgcacgaccccaggccacgcctccacgcacgctcactctacagtaacaaacactcgctcgttccggggtcctgctccgcttctctggctccatccgttgggaaacaaagtcctacgccctcacccactcggacccgggggcccacgggcaacgacagtagaaagtgtagtacttatcacttgtccgttaccgtttagnggtggggtcgtggtcgtaggtttgggtcgttcggggacgggtacggtaacaacgtcgaccgtcgtacggtcacggacccgaacggccctcggcccccgtcggtacctccgttcgttccccgg

SEQ ID NO: 362750 - DNA, 670 bp, Homo sapiens
  misc_feature: GZ8MTXP02I18W8.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtcgccttggaggtctggctcagttctctacttctaactacgccgcctggtaccgcacgaccccaggccacgccctccacgcacgctcatcacagtaacacactcgctccgttccggtcctgactccgcttctctcggcctcttactcgttacgggaaacaaacgctcgtccctacaccacgtccggaccggggccccagggaccaggacgagtagaaagtgtagtaacttagcctaacgttcgtaccgtttccgtttagtggggtcggggtcggttggtcgttaggtttcgggggtcggtttcggggaccggggtaaacgggtaacccgtaaaacggttccggtaaccccggttacggttaacggtacccgaacccggtaccccgaaacggggtcccgttacccggccccccggggttacgtaccccgttaccgttccgtttccccccgg

SEQ ID NO: 362751 - DNA, 574 bp, Homo sapiens
  misc_feature: GZ8MTXP02GUNEZ.15.34.D01.1.454.CMB.2.raw
  modified_base (293)..(293): a, c, t, g, unknown or other
  modified_base (332)..(332): a, c, t, g, unknown or other
  modified_base (364)..(364): a, c, t, g, unknown or other
  modified_base (431)..(431): a, c, t, g, unknown or other
  modified_base (565)..(565): a, c, t, g, unknown or other
  modified_base (567)..(574): a, c, t, g, unknown or other
tcagtctacgtagccacgaccggtgctcgatttagatcgtctgtgttgggtttgggtccctgagactctcctgtgcagcctctggattcagttctagtaaatactggataagttgggtccgccaggctccagggaagggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattacngtggcgggaggccggagtggtatttggattacgtttcgngggccaggggacccctggccccaccgtctccncacgccctccaccgaacgggccccagtccggtcccttcccccgtggcccgccctgcctccgaggacnccacccgtccgagacgcgacacggcccggtcccgtggggcctcggcccgtagggtaccaaacggtaccgttaccgttcccgacgttaaccgtagacccgtggacggcgggctcggacgaacggtcgacagtagngnnnnnnnn

SEQ ID NO: 362752 - DNA, 535 bp, Homo sapiens
  misc_feature: GZ8MTXP02FFWHB.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaaacactcgctcttccggggtcctgatccgcttctctggctccatccctgggaacaaagctgccctcaccatcgaccgggggcccaggcagacgatgaatgtgattatcacgtgtccgtcctttatggtggggcgtggctagtttgggtgttcgggcgggagggaccaaacgtcgaccgtcctaggtcagcccgaaggcctcgccccctcggtccactctccg

SEQ ID NO: 362753 - DNA, 537 bp, Homo sapiens
  misc_feature: GZ8MTXP02FVK23.15.34.D01.1.454.CMB.2.raw
  modified_base (344)..(344): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcagaccccaggccagcctccacgcacgctcatctacagtacaaacactcgctcttccggggtcctgactccgcttcnctggctccatccgtgggaaacaaagctgccctcaccatcgacgggggcccaggcagacgatgaatgtagattatcactgcgtcctttagtggtggggcgtggctagtttggggtgttcgggcggacgggaccaaacgtcgaccgtctacgggtcagccccgaaggcctcgccccctcggtccaccgtctcccg

SEQ ID NO: 362754 - DNA, 525 bp, Homo sapiens
  misc_feature: GZ8MTXP02FI8Q3.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatccgcttctctggctccatcctgggaacaaagctgccctcaccatcacgggggcccaggcagacgatgaatgtagattatcactgcgtcctttagtgtcggggcgtggctagtttggggtgttcgggcggaggggaccaaagtcgaccgtctacgggtcagcccaaggctcgccccctcgtcactctccg

SEQ ID NO: 362755 - DNA, 599 bp, Homo sapiens
  misc_feature: GZ8MTXP02IA09Y.15.34.D01.1.454.CMB.2.raw
  modified_base (320)..(320): a, c, t, g, unknown or other
  modified_base (464)..(464): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttggaggtctggctcagtctctacttctaactacgccgcctggtaccggcacgaccccaggccagccctccacgcacgctcatctacagtaaccaaacnctcgcttccgtccggggtcctgactccgtcttctctcggctccatccgtagggaaacaaagtcctcgccctacaccacgtccggaccggggcccacggcagacgagtagaatgtacgattacgctactgtcgttacctttaggngggtcggggtcgtggtcgtaggtttcggggtcggttcggggacgggtaacggaaccctaacggtcgtacccggttcgtacggcaacggacccgaaggcccgtccggtcccccgtgtacctccttccgttccccgg

SEQ ID NO: 362756 - DNA, 574 bp, Homo sapiens
  misc_feature: GZ8MTXP02GCK46.15.34.D01.1.454.CMB.2.raw
  modified_base (316)..(316): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgcctccacgcacgctcatctacagtacaaacnctcgcttcgtccggggtcctgactccgcttctctggctccatccgttagggaaacaaagcctcgccctcaccatccgaccggggcccaggcagacgatgaatgtagtattatcacgtcgtcgttcctttagtggtggggtcgtggcgtaggtttggggtgttcgggacggtacgggaccaaagtcggtaccgtccgtacggtccacggtacccgaaggtccctccggtcccccgtcggtcctacctccgtttccccgg

SEQ ID NO: 362757 - DNA, 568 bp, Homo sapiens
  misc_feature: GZ8MTXP02FMBVQ.15.34.D01.1.454.CMB.2.raw
  modified_base (347)..(347): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccggggtcctgatccgcttcnctgctccatcctgggaacaaagctgccctcaccatcgaccgggggcccaggcagacgatgaatgtgattatcactcgtcgttcctttagtggtggggtcgtggtcgttagtttggggtgttcggggacgggtacgggaccaaacgtcggtacccgttccgtacggtccgacgtacccgaacggtccgtccggcccccgttcggtccaccgttccgttcccg

SEQ ID NO: 362758 - DNA, 667 bp, Homo sapiens
  misc_feature: GZ8MTXP02INCCQ.15.34.D01.1.454.CMB.2.raw
  modified_base (322)..(322): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactctacttgtcgtccttgaggtctggctcagtctctacttctaactcgccgccgtcggaccgcacgaccccaggccacgccctccacgcacgctcactctacagtacaaacnctcgcctcgttccgggtcctgctcccgtcttctctcgtctccactccgttagggaaacaaagtcctacgccctcaccactcggaccggggcccaggcacgacgagtgtaatgtagtattactcgtacgtcgttccgtttaccgtttggtcggggttgggggtccgttgggtcggttagggtttttcgggggtcggggtttccggggaccgggggttaacgggtaaacccgtaaacggttcccggtaaacccggttcccggttacggtacccgtaaccggacccgtaaccggtccctaccccgggtcccccgttcggtacccgtacccgtttcccgtttcccccgg

SEQ ID NO: 362759 - DNA, 572 bp, Homo sapiens
  misc_feature: GZ8MTXP02GSZG1.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgccctccacgcacgctcatctacagtacaaacactcgctcgttccggggtccctgactccgcttctctggctccatccgttagggaaacaagctcgccctcaccatcgaccgggggcccaggcagacgatgaagtgtagacttatctactcgtcgttcctttagtggtcggggtcgtggcgttaggtttggggtcgttcgggacgggacgggaaccctaaagtcgtaccgtcgtacggtcacgcccgaacggtccctccgtcccccgtcggtccaccttcgttccccg

SEQ ID NO: 362760 - DNA, 562 bp, Homo sapiens
  misc_feature: GZ8MTXP02IRFV0.15.34.D01.1.454.CMB.2.raw
  modified_base (319)..(319): a, c, t, g, unknown or other
  modified_base (345)..(345): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgcctccacgcacgctcatctacagtacaacactcnctcgtccgggtccctgctccgcttcnctgctccactcgtgggaacaaagctcgccctcactactcgaccgggggcccaggcagacgatagatgtgattatccactcgtacgttcctttagtcggttggggtcgtgggtcttaggtttggggttggttcggggcgggaacgggtaccaaacgtcggtaccgtcgtacgtcacggacccaaggcctcgacccccgtcggtacctccgtcttcccg

SEQ ID NO: 362761 - DNA, 607 bp, Homo sapiens
  misc_feature: GZ8MTXP02HYSP7.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatctacagtacaaacactcgcttcgtccgggtccctgactccgcttctctcggctccattccgttagggaaacaaagcctcgcccctcacccatccgaccggggccacggcagacgatagaatgtagattatcactcgtcgttccgtttagtcgggtggggcgtggtcgtaggtttcggggtcggttcggggacggggtaacggggaacccgtaaacggtacggtacccggttaccgtacggtaccgacggacccgaacggtccgtccgtcccccgtccggtaccctaccgttccgtttcccg

SEQ ID NO: 362762 - DNA, 655 bp, Homo sapiens
  misc_feature: GZ8MTXP02HEOUB.15.34.D01.1.454.CMB.2.raw
  modified_base (316)..(316): a, c, t, g, unknown or other
  modified_base (430)..(430): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttggaggtctggctcagtctctacttctaactccgccgcctggtaccgcacgaccccaggccagccctccacgcacgctcatcacatacaaacnctcgcttccgtcccggggtcctgactccgtccttcgtcgtgcctccacttccgttagggaaacaacgctcgccctacaccagtccggaccggggcccagggccaagacgtaagngtaaagtgtacgtattaactccgtaacgtcgttaccgtttcccgtttaggtcggggtcggggtcgtcgggtcgttacggtttcggggtacggtttcgggaccggggtaaacggtacccgtaaaacggttccggtaacccggttaccgtacggtaccgaaccggcccgtaaacgggtcccttcccggtcccccgttacggtaccctaccgtttccgtttcccccgg

SEQ ID NO: 362763 - DNA, 597 bp, Homo sapiens
  misc_feature: GZ8MTXP02HNLG0.15.34.D01.1.454.CMB.2.raw
  modified_base (314)..(314): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtccctggagggacagtcacactcacttgtgccttgaggtctggctcagtctctacttctaactacgccgcctggtaccggcacgaccccaggccagcctccacgcacgctcatcacagtacaaaacnctcgctccgttccggggtccctgactccgcttcctcgtcggctccatccgttagggaaacaaacgtcctacgccctacaccacgtccgaccgggggcccaggcagacgatagaactgtagtaattacacacgtcgtccgttacctttagtcgggtgggggtcgtgggtcgtaggtttggggtcgttcggggacgggtaacgggaaccctaaaacgtcggacccgtaccgtagtaccgacgacccgtaaggcccgtcgcccccgtcgtcctacgttccttcccg

SEQ ID NO: 362764 - DNA, 589 bp, Homo sapiens
  misc_feature: GZ8MTXP02GX2UY.15.34.D01.1.454.CMB.2.raw
  modified_base (316)..(316): a, c, t, g, unknown or other
  modified_base (443)..(443): a, c, t, g, unknown or other
  modified_base (462)..(462): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtacccgcacgaccccaggccagccctccacgcacgctcatcacagtacaaacnctcgctccgttccggggtcctgtactccgtcttctctcggcctccattccgttagggaaacaaacgcctacgcccctcaacccagtccgacccgggggcccagggcacggacgatgaatgatattanctactcgtcgttctttagnggtgggcgtggacgtggtttgggtggtcgggacgggaacggaccaaacgtcgtaccggtacgtacgggaccacgacccgaacggtccgtcccgtcccccgtcggtacctccgttccgtttcccccgg

SEQ ID NO: 362765 - DNA, 608 bp, Homo sapiens
  misc_feature: GZ8MTXP02IEU71.15.34.D01.1.454.CMB.2.raw
  modified_base (595)..(595): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactacgccgctggtaccggcacgaccccaggccacgccctccacgcacgctcatctacagtaacaaacactcgctccgttcccggggtccctgactccgtcttcctctcggctccattccgttagggaaacaaacgctccgccctcacccacgtccgaccgggggcccagggacagacgatagaagtgtgtaattactcacgttgtccgtttaccgttttagtgggttcgggggtcgttcgggtcgttaggtttggggtcggtttcggggacgggacgggtaaccaaacgtcgtaaccgtcgtacgtccacggaccaacggtcctccgccccgtcggtaccnccttcgttccccg

SEQ ID NO: 362766 - DNA, 602 bp, Homo sapiens
  misc_feature: GZ8MTXP02IH69R.15.34.D01.1.454.CMB.2.raw
  modified_base (299)..(299): a, c, t, g, unknown or other
  modified_base (334)..(334): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggagcttggtccagccgtgggggtccctgagactctcctgtgcagcctctggattcagttcagtaaatctggataagttggtccncaggctccgaggggaggctggagtgatggcaatangaaaccagacggagtgataaacatcatggtagggctcgtggtcgcgacgggggcctattccacttatcctaccgagaacgacaaaccgccaaaagtaactacgtaagtgttatttgaacctaaaagttcgaactagaccctagacgacgaccgaacgacgacggcgtgtagttacttagcgttcggacggggacggtaccggtaggttcggttaagtttagggtaacgtttacggtttcggacggggtaccggtaacggggttccccg

SEQ ID NO: 362767 - DNA, 576 bp, Homo sapiens
  misc_feature: GZ8MTXP02JGAW6.15.34.D01.1.454.CMB.2.raw
  modified_base (447)..(447): a, c, t, g, unknown or other
  modified_base (468)..(468): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccggggtcctgactcccgcttctctcggctccactccgttagggaaactaaacggcctcgcccctacacccactccgaccgggggcccacgggacgagacgagtagaatgtgtattanctacgtcgtcgttcctttagngggtggggcgtggctaggtttgggtcggttcggacgggacgggaccgtaaacgtcgaccgtccgtacggtccacgcccaaggctaccgccctcggtcaccttctcccg

SEQ ID NO: 362768 - DNA, 550 bp, Homo sapiens
  misc_feature: GZ8MTXP02I0PV0.15.34.D01.1.454.CMB.2.raw
  modified_base (428)..(428): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctccgttccggggtccctgactccgcttctctcgctccatccgttagggaaacaaagcctcgccctcacccatccgaccgggggcccaggcagacgatagaatgtanattatctactcgtcgttcctttagtggtggggcgtggcgtagtttgggtgtcgggcggacggaccaaacgtcgaccgtcgtacgtcacgaccgaacggctcgccccgtcgtcactcttcccg

SEQ ID NO: 362769 - DNA, 614 bp, Homo sapiens
  misc_feature: GZ8MTXP02H20I1.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactcgccgcctggtaccggcacgaccccaggccagccctccacgcacgctcatctacagtaacaaacactcgctccgttccggggtccctgactcccgtcttcctcgtcgtacctccacgttccgttagggaaacaaacgcctcgccccctacacccacgtccgaccgggggcccaggccaagacgatagtaatgtagtaattatctacgtcgtcgtttcctttagtggtggggcgtggtcgtagtttgggttcggtcgggacgggtacggaacctaaaccgtcggacccgtaccgtacggtccgacgtaccccgaacggtccctaccgtcccccgtacggtccctaccgttccttccccg

SEQ ID NO: 362770 - DNA, 704 bp, Homo sapiens
  misc_feature: GZ8MTXP02GFZVS.15.34.D01.1.454.CMB.2.raw
  modified_base (333)..(333): a, c, t, g, unknown or other
  modified_base (353)..(353): a, c, t, g, unknown or other
  modified_base (366)..(366): a, c, t, g, unknown or other
  modified_base (430)..(430): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtcgtccttgaggtctggctcagtctacttaccttactaactaccgcccgtccgtcggtacccgcaccgaccccgaggccacgcctccacgccacgctcatactacagtaacaacnctcgctaccgttccggtccngatcccgtctctncgctccatccgtaggaaacacgctccgcctacacacgtccgggaccgggccaaggcaacggtanagtatagtgtatattactacgtacgttcggttcgtttacgtttagggtcggggtacggggtcggtcggttacggtttacggggtttcgggggttaccggggtacgggggaacccgggtaaaaccgggtaaaacccgttaaaccgggttaccgggtaaacccggttaccgggtaaccggtacccgtaacccggtaacccggtaacccggtccccgttacccccgggtacccccggttacggtaccccgtttacccggtttccccgtttcccccgg

SEQ ID NO: 362771 - DNA, 534 bp, Homo sapiens
  misc_feature: GZ8MTXP02JW3KS.15.34.D01.1.454.CMB.2.raw
  modified_base (320)..(320): a, c, t, g, unknown or other
  modified_base (419)..(419): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcnctctccggggtcccctgatccgcttctctggctccatccttagggaacaaagctgccctcaccatcacgggggcccaggcagacgatgaatgtgattancactgctcttatgtggggcgtggctagtttgggtgttcgggcggacggggaccaaagtcgtaaccgtcctacgggacagcccgaaggccttcgcccccttggccacgtcttcccg

SEQ ID NO: 362772 - DNA, 554 bp, Homo sapiens
  misc_feature: GZ8MTXP02I6I5R.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgccacgctcatctacagtacaaacactcgctcttccggggtccctgactccgcttctctggctccatccttgggaacaaagctgccctcaccatcgacggggcccaggcagacgatgaatgtagattatcactgcgttcctttagtgttgggcgtggcgtagtttggggtgttcgggcgggaacgggaccaaaacgtcggaaccgtccgtacggtacacgcccgaaacggccgtcgcccccttcggtcctaccgtcgtttcccg

SEQ ID NO: 362773 - DNA, 595 bp, Homo sapiens
  misc_feature: GZ8MTXP02JYUJJ.15.34.D01.1.454.CMB.2.raw
  modified_base (319)..(319): a, c, t, g, unknown or other
tcagtctacgtagccacgaccggtgctcgatttagatcgtctgtgttgggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgccctccacgcacgctcatctacagtacaaacnctcgctcgttccggggtccctgactcccgtcttctctcggctccacttccgtagggaaacaaacgctcgccctacaccacgtccggaccgggggcccaggacagacgatagaatgtagtattatctactgtacgttcctttagtggtgggcgtggtcgttaggttggggttcggttcgggcgggtaacgggaacctaaacgtcggtaccggtacgtacggtaccgaccgaccgaacggtccgtccgtcccccgtacggtcctaccgtccttccccg

SEQ ID NO: 362774 - DNA, 558 bp, Homo sapiens
  misc_feature: GZ8MTXP02IYNC0.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgtccttgaggtctggctcagtctctacttctaactacgccgccgtcggtaccgcacgaccccaggccacgcctccacgcacgctcatcacataacaacactcgctcgtccgggtcctgctccgcttctctcgctccatccgtagggaaacaaagcctcgccctacacccacgtccgaccgggggcccaggcaagacgacgtagaatgtagtattatcactcgtccgttacctttagtggtgggcgtggtcgttaggtttgggtgttcggacgggacggacaacgtcgaccgtcgtacgtcacgaccgaagccgtccgccccgtcgtctacctcttcccg

SEQ ID NO: 362775 - DNA, 629 bp, Homo sapiens
  misc_feature: GZ8MTXP02GMQGT.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactacgccgcctggtacccggcacgaccccaggccacgccctccacgcacgctcatctacagtaccaaacactcgctccgttccggggtccctgactcccgcttctctggcctccattccgtagggaaacaaagcctcgccctacaccactccggaccgggggcccaggccaagacgatagaatgtagattatcaacttcgtccgtttaccgtttagtggggtcggggtcggtcggtacgttaggtttggggtacgggtttcggggacgggtaacgggtaaccaaacggtccgtaaccggtccgttaacggccgaacggaccccgaaacggtcctcccggtacccccgtcggtacctaccgttccgttcccccgg

SEQ ID NO: 362776 - DNA, 544 bp, Homo sapiens
  misc_feature: GZ8MTXP02J0ZXL.15.34.D01.1.454.CMB.2.raw
  modified_base (427)..(427): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagcctccacgcacgctcatctacagtacaaacactcgctcttccggggtcctgactccgcttctctggctccatcccgttgggaaacaaagctcgccctcacccatccgacgggggcccaggcagacgatgaatgtagattancactgcgttcctttagtcggtggggcgtggctagtttgggtgttcgggcggtacgggaccaaacgcgaccgtcgtacggtccacgcccgaaggcctcgccccgtcgtcactctcccg

SEQ ID NO: 362777 - DNA, 619 bp, Homo sapiens
  misc_feature: GZ8MTXP02IJCOU.15.34.D01.1.454.CMB.2.raw
tcagtctacgtagcccacgaccggtgctcgatttagatcgtctgtgttggggttgggaagcctgagaacacttagccttcatgagtgtccccaccatggcctggatgatgcttctcctcggactccttgcttatggatcagggagtggattctcagactgtggtgacccaggagccattcgttctcagtcgtccccgtgggagggacagtcacactcacttgtgccttgaggtctggctcagtctctacttctaactacgccgctcggtaccggcacgacccaggccacgcctccacgcacgctacatctaacagtaacaacactcgctccgttccggggtcctgactccgtcttctcgtcgctccactccgttagggaaacaaacgcctaccgcccctacaccacgccggaccgggggacccgaaggcgaagacgagtagaattggtatattatcctacgttcgttccgtttcgtttaggtcgggttggggcgtggtgttagggtttgggtacggtcgggacgggaacggtaaaccgaaacgtcggtaccgtaccgtacggtaccgacgacccgtaacggtccctccggcccccgttcgtcctaccttccgttccccg

SEQ ID NO: 362778 - DNA, 608 bp, Homo sapiens
  misc_feature: GZ8MTXP02GMRWJ.15.34.D01.1.454.CMB.2.raw
  modified_base (320)..(320): a, c, t, g, unknown or other
  modified_base (338)..(338): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactcgccgcctcggtaccggcacgaccccaggccacgccctccacgcacgctcatctacagtaacaaacnctcgctcgtccgggtccngctcccgcttctctgctccatccgtagggaaacaagcctcgccctacaccacgtccggaccgggggcccgacgggaccgaacggacgtagtacgtaagttgtagtattactctaacgtcgtaccgttcgtttaggtgggtggggtcgtgggtcgttaggtttggggtcggttcggggacgggtaacggaaccgaaacgtcggtaccgtcgtacggtaccgacgtccgaacggtccgtcccgtccccgtcggtcctccgtccgttccccgg

SEQ ID NO: 362779 - DNA, 692 bp, Homo sapiens
  misc_feature: GZ8MTXP02GTFI3.15.34.D01.1.454.CMB.2.raw
  modified_base (325)..(325): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgtccttggaggtctggctcagtctctacttctaactaccgcccgcgtcggtaccgcacgaccccaggccacgcctccacgcacgctcatctacatacaaacnctcgctcgtccgggtcctgactccgcttcctcgtcgtctcctacgtccgttagggaaacaaacggcctacgccctacaaccctacgtaccgggacccgggggcccaaggaccgaacggtaacgtacgttaggtaaagtggttacgtaatttaaccgtactaacgttcgttccgtttaccgttttagggtcgggttacgggggtcggttacggtacggtttagggttttcgggggttagggttaccgggggacgggggtaaacggtaaacccgtaaacggttaccggtacccggttaccgttacgggaccgtaccggaccgaacggtccgtcccgtccccgtacggtacctaccgttccgttccccgg

SEQ ID NO: 362780 - DNA, 539 bp, Homo sapiens
  misc_feature: GZ8MTXP02FJGN5.15.34.D01.1.454.CMB.2.raw
  modified_base (380)..(380): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccgtggaggacagtcacactcacttgtgccttgaggtctggctcagtctctacttctaactacgccgcctggtaccggcacgaccccaggcccagccctccacgcacgctcatctacagtacaaacactcgctcttccggggcctgactccgcttctctgctccatcctgggaacaagctgccctcaccancaccgggggcccaggcagacgatgaatgtagattactccactcgcgttccgtttagtggtggggcgtgggctagtttgggtgttcgggcggacgggtaccaaactggacccgtaccgtacgtccagcccaaggcctcgccccctcggtccacgtctccg

SEQ ID NO: 362781 - DNA, 582 bp, Homo sapiens
  misc_feature: GZ8MTXP02IA3TS.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggcccagccctccacgcacgctcatctacagtaacaaacactcgctcgttcccggggtccctgatcccgcttctctggctccatccttgggaaacaaagcctcgccctcacccatcgacggggcccaggcagacgatagaatgtgattactcgactgtccgttcctttagtggtcgggggcgtggcgtaggtttggggtggttcgggcgggtaacgggaccaaacggtcgacccggtaccgtaggtaccgacgacccgaacggtccgtccgcccccgttcggtcctaccttccgttccccgg

SEQ ID NO: 362782 - DNA, 549 bp, Homo sapiens
  misc_feature: GZ8MTXP02H5049.15.34.D01.1.454.CMB.2.raw
  modified_base (219)..(219): a, c, t, g, unknown or other
  modified_base (304)..(304): a, c, t, g, unknown or other
  modified_base (333)..(333): a, c, t, g, unknown or other
  modified_base (342)..(342): a, c, t, g, unknown or other
  modified_base (345)..(345): a, c, t, g, unknown or other
  modified_base (417)..(417): a, c, t, g, unknown or other
  modified_base (420)..(420): a, c, t, g, unknown or other
  modified_base (444)..(444): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcaacactcacttgngccttgaggtctggctcagtctctacttctaactacgccgctggtaccggcagaccccaggccagcctcacgcacgctcatctanagtacaaaacactcgctcgtccgggtccngatccgctntcnggctacatccgttagggaaacaaagcctgccctcacatcgacggggcccagcagacgatgaatgtagattancancggtactcttatggtgggcgtggngtgttggttggttcggtacggacggacgaaaccgacgtaccgtaccgtacgtcgacgaccgaacggacgtccgccccgtccggtaccgtaccgtacgtttccccg

SEQ ID NO: 362783 - DNA, 626 bp, Homo sapiens
  misc_feature: GZ8MTXP02IVNJI.15.34.D01.1.454.CMB.2.raw
  modified_base (494)..(494): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggatcgtgggggagcttggtccagccgtgggggtccctgagctctcctgtgcagcctctggattcagttacagtaaatactggaataagttcgggccgccaggctccgaggggaagggctaggaggtggagtcggaccctaaatagtacgaaaccaaggaacggtaagtgaaagtaaacatacagttggtcgggcttcgtggtacgcgacgggccgtatttccgactatcctaccaagtacgaacaaacgccaaagtactataagtgttaatttagactaaagtcgaaacngaccgtgagacgccgaacacgacgcgtgtagtagttacgtcggtgggacggggtcgggaccgggtggtttagggttaacgtttggtaacgtttcgtttacgggtcgggggtaccgtaacgggggttccccgg

SEQ ID NO: 362784 - DNA, 582 bp, Homo sapiens
  misc_feature: GZ8MTXP02GRT0M.15.34.D01.1.454.CMB.2.raw
  modified_base (318)..(318): a, c, t, g, unknown or other
  modified_base (397)..(397): a, c, t, g, unknown or other
  modified_base (435)..(435): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactacgccgcctggtaccggcacgaccccaggccagcctccacgcacgctcatctacagtaacaaacnctcgcttcgttccggggtcctgactcccgtcttctctaggctccatccgtagggaaacaaagcctcgccctacacctancggaccggggcccaggcagacgatagaatgatattacncactcgtcgttcttagtggtgggcgtggcgttaggtttcgggtggttacggggacggaacgggaacccaaacgtccggtaaaccgtccgttaacgccgaacgacccgaaggcctcccgccccctcggaccctacctccgttcccccg

SEQ ID NO: 362785 - DNA, 707 bp, Homo sapiens
  misc_feature: GZ8MTXP02HIMJ9.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttactaactacgccgcctggtacccggcacgacccccaggccacgccctccaccgcacgctcactctaacataaccaaacactcgccttccgttcccggggtccctgtactcccgtccttctcgtcggtaccttcccacttcccgttaaggggaaacaaacggccttaccggcccccttcgaaccctacgtacccggacccgggggacccccaggggaccaacggaccgagtagaactggtatattactcacgtcgtcgttccgtttaggtcggttggggccgttggtacgtaggttttcgggggtacgggttcgggggacgggtaaacggggtaacccgtaaaacggttcccggtaacccggttaccgttaacggggtccgaaaccggccccgaaacggggtccctacccgggtacccccccggttccgggtaccctcccggtttcccgtttcccccgg

SEQ ID NO: 362786 - DNA, 564 bp, Homo sapiens
  misc_feature: GZ8MTXP02FMDSK.15.34.D01.1.454.CMB.2.raw
  modified_base (448)..(448): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccgcacgaccccaggccagccctccacgcacgctcatctaacagtaacaaacactcgcttccgttccggggtccctgactccgtcttctctggcctcattccgtagggaaactaaagctcgccctcaccatcgaccggggcccaggcagacatagaatgtagattatcactgtcgtctttagnggtgggcgtggcgtagttgggtgttcgggcggtaacggaccaaacgtcgaaccgttcgtacggtacacgacccgaaggtcctcccggcccccttcggtacctacctccgttccccg

SEQ ID NO: 362787 - DNA, 599 bp, Homo sapiens
  misc_feature: GZ8MTXP02G64M7.15.34.D01.1.454.CMB.2.raw
  modified_base (317)..(317): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtcgccttggaggtctggctcagtctctacttctaactcgccgcctggaccggcacgaccccaggccacgcctccacgcacgctcatctacagtaacaaacnctcgcttccgtccgggtcctgctccgtcttctctcgcctccacttccgttagggaaacaaacgctcgccctcaccacgtcgaccggggcccaggcagacgatgaatgtgtattactctactcggtacttcctttagtgggtcgggcggtggtcggttaggtttgggggtacggttcgggacgggtaacgggtacccgtaaacggtccggtaaccggtccgtacggtaccgacggacccgaaggtcccgtccggcccccgtcggtccctaccgttccgtcccg

SEQ ID NO: 362788 - DNA, 565 bp, Homo sapiens
  misc_feature: GZ8MTXP02F0SKK.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggcccagccctccacgcacgctcatctacagtacaaaacactcgcttccttccggggtccctgactccgctttctctcggctcccatccgttgggaaacaaagcctcgccctcaccatcgaccggggcccaggcagacgatagaatgtagattatcactcgtcgttcctttagtggtcggggcgtggctagtttgggtgttcgggcggacgggaccaaacgtcgaccgtctacggtccacgacccgaaggtcctccgcccccgtacggtccaccgttcttcccg

SEQ ID NO: 362789 - DNA, 636 bp, Homo sapiens
  misc_feature: GZ8MTXP02HRTZY.15.34.D01.1.454.CMB.2.raw
  modified_base (324)..(324): a, c, t, g, unknown or other
  modified_base (328)..(328): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtcgcctttgaggttctggctcagtctctacttctaactaccgccgcctggtaccgcacgaccccaggccacgccctccacgcaccgctcatcacataacaaacnctcnctccgtccgggtccctgactccgcttctcgtcgctaccatccgtagggaaacaagcctcgccctacaccacgtccgaccgggggcccaggcaagacgatagaatggtactattactctacttcgtaccgtttactttggtcgggtcgggggtccgtacgggtcgttagggttttggggtcgggttacggggaccggggtaacggtaacccgtaaaacgtccggtacccggttacgtacggtacccacggacccgaacggtcccgtacccggtcccccgtcggttacccaccgtttcccgttacccccg

SEQ ID NO: 362790 - DNA, 570 bp, Homo sapiens
  misc_feature: GZ8MTXP02GGLH9.15.34.D01.1.454.CMB.2.raw
  modified_base (455)..(455): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccacgcctccacgcacgctcatctacagtacaaacactcgctcgttccggggtcctgctccgcttctctcggctccattccgtagggaaacaaagctcgccctcaccatccgacggggcccaggcagacgatgaatgtagattatcactgtcgttcctttagtggtcggggngtggcgtaggtttggggtgtcggggcgggaacgggaccgaaacgtcggtaccgtaccgtacggtccgacgacccgtaaggcctcccgtcccccgtcggtcctaccgttcttcccg

SEQ ID NO: 362791 - DNA, 557 bp, Homo sapiens
  misc_feature: GZ8MTXP02HI672.15.34.D01.1.454.CMB.2.raw
  modified_base (317)..(317): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatcacagtacaaacnctcgctcttccggggcctgatccgcttctctcgctccatccgtagggaaacaagctcgccctcaccatcgacgggggccaggcagacgatgaatgtagattactcatcgcgttctttagtcggtggggcgttaggctaggtttgggtcgtttcgggacgggtaacgggaccaaaacgtcgtaaccggtcgtacgggtcaacgcccgaaggtctccgcccctcggtcctactccgttcccg

SEQ ID NO: 362792 - DNA, 668 bp, Homo sapiens
  misc_feature: GZ8MTXP02HCEK3.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgcgtccttggaggtctggctcagttcctctacttctaacctaccgccgccgtcggtacccgcacgaccccaggcccagccctccacgcacgctcatcaacagtaacaaactctccgtcttcccggttcccggggtcctagtctcccgtctttctcgtacgcctcctacttccgtagggaaaacacgtcctccgaccctacaccgtacgccggaacccgggggcccaagggcgaacgacgaagtagtaagttgagtattactactacgttacgtcgtttccgttaggtggcggggtcgtcgggtattggttggggttcggttaccggacggggtaaccggtaaaccgtaacgtcccggtaacccgttaccggtaacggtccctaaccgttacccgaacggtcccgtcccggtaccccccgttgtacccctaccgtttcctttacccccg

SEQ ID NO: 362793 - DNA, 559 bp, Homo sapiens
  misc_feature: GZ8MTXP02JTKNH.15.34.D01.1.454.CMB.2.raw
  modified_base (303)..(303): a, c, t, g, unknown or other
  modified_base (313)..(313): a, c, t, g, unknown or other
  modified_base (414)..(414): a, c, t, g, unknown or other
  modified_base (422)..(422): a, c, t, g, unknown or other
  modified_base (429)..(429): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccgcacgaccccaggccagccctcacgcacgctcatctanagtacaaacnctcgctcgttccggggtcctgactccgcttctctgctcctatcccgttagggaaacaacgctacgccctcaccagtcgacggggcccagggctagacgtanagaatgtntaattanctactcgcgttaccttagtggtgggtcgtggcgtaggttgggtagtcgggcgggtacggacgaagtcgtaaccggtcgtaacggtcaacgaccgtaacggctccggacccgtcgtacctccgtcttcccg

SEQ ID NO: 362794 - DNA, 607 bp, Homo sapiens
  misc_feature: GZ8MTXP02J2KE0.15.34.D01.1.454.CMB.2.raw
  modified_base (270)..(270): a, c, t, g, unknown or other
  modified_base (279)..(279): a, c, t, g, unknown or other
  modified_base (316)..(316): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgcgccttggaggtctggctcagtctctacttctaactacgccgctggtaccgnacgaccccnggccagccctccacgcacgctcatcacagtaacaacnctcgctctccggggtcctgactccgcttctcgtggctccatccgtagggaaacagctcgccctcaccacgtccgacgggggcccaggccagacgtatacgtaagtgtagtattacgtactacgtcggtccgttcctttaggtcgggttcggggcggtttcgggtcgttaggtttcgggggttacggtttcggggacggtacggggaaccctaaacgtcggtaacccgtcgtacggtccgacgtacccgaacggtcctccggtcccccgttcggtccaccgtccgttcccgg

SEQ ID NO: 362795 - DNA, 598 bp, Homo sapiens
  misc_feature: GZ8MTXP02JE5P4.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagacatcgttctcagtcgtccctggagggacagtcacactcacttgtcgccttgaggtctggctcagtctctacttctaactcgccgctcggtaccgcacgacccaggccagccctccacgcacgctcatcacagtaacaaacactcgctccgttccggggtcctgactcccgtcttctctcgcctccactccgttagggaaacaaacgctcgccctcaccacgtccgaccggggcccaggcaacgacgagtagaagtgtagtattactccgtacgtcgtccgtttaccgtttggtcgggtcggggtcgttcgggtcgttaggtttggggtcggttcgggacgggaacggtaacctaaacgtcggtaacccgtcgtacggtccacgaccgaagcctccgccccgtcgtcctaccgtcgttccccg

SEQ ID NO: 362796 - DNA, 588 bp, Homo sapiens
  misc_feature: GZ8MTXP02HID07.15.34.D01.1.454.CMB.2.raw
  modified_base (450)..(450): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatcacagtaacaaacactccgctccgttccggggtccctggactccccgtcttctctcggcctccactccgttagggaaaacaaacggcttcgcccctacaacccacgtccggacccgggggcccaggcacgacgatagaatgtagattanctacgtcgtcgttcttagtggtgggcgtggcgtagttgggtggttcgggacggtacgggacctaaacgtccgtaccggtacgtacggtcacgacccgtaagccgtaccgcccccgtaggtccctacgtcctttccccg

SEQ ID NO: 362797 - DNA, 578 bp, Homo sapiens
  misc_feature: GZ8MTXP02JGSOR.15.34.D01.1.454.CMB.2.raw
  modified_base (315)..(315): a, c, t, g, unknown or other
  modified_base (319)..(319): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggaccgcacgaccccaggccacgccctccacgcacgctcatctacagtacaaacnctcnctccgttccggggccctgactccgtcttctctgctccatccgttagggaacaagcctacgccctcaccatccgacgggggcccaggccagtacgatgtaatgtagtattatctactcgtcgttcgtttagtgggtcgggtcgtggacgtggtttgggtggttcgggcgggaacgggaccgaaacgtcgggaacccgtccgttacggacgaccggaccgaacggtccaccggtcccccgtcggtccacctcgtttccccg

SEQ ID NO: 362798 - DNA, 643 bp, Homo sapiens
  misc_feature: GZ8MTXP02GM3V3.15.34.D01.1.454.CMB.2.raw
  modified_base (317)..(317): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtaccgcacgaccccaggccacgcctccacgcacgctcatctacagtacaaacnctcgcttcgttccggggtcctgtactccgtcttctctcggtcctcctacttcccgttaggggaaacctaaacggtcctccgaccccctaccaaccctacgtcccggaacccgggggcccagggaccaacggacgtatagtaaagtgtagtattactcacgtcgtcgttcctttagtggtggggtcgtggtcgttaggtttggggttcggttcggggacgggtaacgggtaacccgtaaacgtccggtaacccggtccggttacggtaccgacggacccgaacggtcccgtcccggtcccccgtcggtccctaccgttccttccccg

SEQ ID NO: 362799 - DNA, 548 bp, Homo sapiens
  misc_feature: GZ8MTXP02IUOPK.15.34.D01.1.454.CMB.2.raw
  modified_base (315)..(315): a, c, t, g, unknown or other
  modified_base (333)..(333): a, c, t, g, unknown or other
  modified_base (350)..(350): a, c, t, g, unknown or other
  modified_base (392)..(392): a, c, t, g, unknown or other
  modified_base (407)..(407): a, c, t, g, unknown or other
  modified_base (412)..(412): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcactttgtcgccttgaggtctggctcagtctctacttctaactcgccgtcctggtaccgcacgacccaggccagccctccacgcacgctcatcacatacaacnctcgctcctccgggtccngctccgctctctgctcnctcgtggaacagctcgcctcacagcgacgggccaggcagacngtacagtgagtattntacgntcgtccgttccgtttagtcgggtcgggtgtggttacgtggtttcgggtgttcgggcggtacggacctaaacgtcgtaccgtcgtacggtaccacggtaccaacggtctaccgtcccgtcggtctactcgttacccg

SEQ ID NO: 362800 - DNA, 608 bp, Homo sapiens
  misc_feature: GZ8MTXP02GZOFT.15.34.D01.1.454.CMB.2.raw
  modified_base (356)..(356): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgcctggaccgcacgaccccaggccacgcctccacgcacgctcatcacagtaacaaacactcgctccgttcccgggcctgactccgtcttctctcgcctcnctcgtagaacaacgctcgcctcacacgcgaccgggccacggacacgacgactagaactgtagtattactactacgtcgttacgttcgtttacggtgggtcggggtcggtcggtcgttaggtttggggttcggtacggggacgggtaacgggaaaccgtaaacgtaccggtacccgttaccgtacggtaccgaccggaccgtaaccgtcccgtaccggtacccccgtcggtccctaccttccgtttacccccg

SEQ ID NO: 362801 - DNA, 624 bp, Homo sapiens
  misc_feature: GZ8MTXP02G104W.15.34.D01.1.454.CMB.2.raw
  modified_base (316)..(316): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatcacagtacaaacnctcgctcgtcccggggtcctgactcccgcttctctcggctccactccgttagggaaacaaagctcgccctcacccactccgaccgggggcccacggcacgacgagtagtaagtgtagattatactacgtcgtcgttcctttaggtggtcggggtcgtggtcgtaggtttggggttcggttcggggtacgggaacgggtaaccctaaacgttccggtacccggtacccgtacgggtaccgaccggaccccgtaacggcccgttaccccggccccccggttcgtacccgtacccttcccggtttcccccg

SEQ ID NO: 362802 - DNA, 619 bp, Homo sapiens
  misc_feature: GZ8MTXP02G6BE3.15.34.D01.1.454.CMB.2.raw
  modified_base (439)..(439): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttggaggtctggctcagtctctacttctaactacgccgcctggtaccggcacgaccccaggccagccctccacgcacgctcatcacagtaacaaaacactcgcctcgttcccggggtccctgactcccgtcttctctcggctccatccgttagggaaactaaaggcctcgcccctacacccatccggaaccgggggcccaggccaagacgtangaatggataattatctacgtgtccgtttacctttaggtgggttggggtccgttgggtaccgttaggttttgggggtcgggtttacggggacgggtaacggggtaaccctaaacgtcggtacccgttacgtacggtccacgtaccgaacgctccggcccctaggtccaccgttctaccccg

SEQ ID NO: 362803 - DNA, 547 bp, Homo sapiens
  misc_feature: GZ8MTXP02JYB0W.15.34.D01.1.454.CMB.2.raw
  modified_base (317)..(317): a, c, t, g, unknown or other
  modified_base (387)..(387): a, c, t, g, unknown or other
  modified_base (426)..(426): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgaccccaggccagcctccacgcacgctcatctacagtacaaacnctcgctcgttccggggtccctgactcccgcttctctggctccatccgtagggaaactaaagctgcccctnaccatcgacggggcccaggcagcgatgaatgtagattancactgtcgttactttgtggtgggcgtggtcgtagtttgggtgttcgggcggacgggaaccaacgtcgaccgtcgtacggtcacgcccaaggcctccgccccgtcggtcctaccgtctcccg

SEQ ID NO: 362804 - DNA, 612 bp, Homo sapiens
  misc_feature: GZ8MTXP02IVFXB.15.34.D01.1.454.CMB.2.raw
  modified_base (320)..(320): a, c, t, g, unknown or other
  modified_base (357)..(357): a, c, t, g, unknown or other
  modified_base (438)..(438): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtcgccttgaggtctggctcagtctctacttctaactaccgccgcctggtaccgcacgaccccaggccacgcctcacgcacgctcatctaacataacaaacnctccgcttccgttccggggtcctgacttccgcttctntcggctccatccgttagggaacaaacgtctcgccctcaccagtccgacggggccaggcagacgatagaatcgtagtattanactacgtcgtcgttacctttaggtcgggtggggtcgtcggtcgttaggtttcggggtacggtttcgggacgggtaacggactaaaaccggttcgaaccgttccgtacggtaccgacggacccgtaacggtccgtacccgtacccccgtcggtaccctaccgttccgttaccccg

SEQ ID NO: 362805 - DNA, 652 bp, Homo sapiens
  misc_feature: GZ8MTXP02HIDBO.15.34.D01.1.454.CMB.2.raw
  modified_base (281)..(281): a, c, t, g, unknown or other
  modified_base (458)..(458): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccctgggagggacagtcacactcacttgtcgccttggagtctggctcagtctctacttctaactcgccgcgtggtaccgcacgacccnggccagcctccacgcacgctcatctacagtaacaaactctcgcttccgtccggggtccctgactccgtcttctctcgctccattccgtagggaaacaacgcctcgccctacaccctacgtccggacccgggggacccacgggacgaacgacgtacgtagtaacgtgtagtatttacnctacgtcgtcgtttcgtttaacgtgggtcggggtcggtggtcgttaggtttcggggtggttcggggacgggtaacgggtacccgaaaacgttccgggtaaccgttccgtaacgggtccgaaccggtacccgaacgggtccgtccccggtacccccggttacggtaaccccgttcccgttccggtttaccccccg

SEQ ID NO: 362806 - DNA, 584 bp, Homo sapiens
  misc_feature: GZ8MTXP02HQJ9A.15.34.D01.1.454.CMB.2.raw
  modified_base (303)..(303): a, c, t, g, unknown or other
  modified_base (375)..(375): a, c, t, g, unknown or other
  modified_base (461)..(461): a, c, t, g, unknown or other
  modified_base (464)..(464): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtggggggtccctgagactctcctgtgcagcctctggattcagttctagtaaatctggataagttgggtccncaggctccgaggggaggggctgggagtggatggacctaaatatgaaaccaaggacggaaagtgaataaaacntcagtggtgggctcgtgtgcgaggggccattcactatcctacagagaccaacgaccaagaatctagtgtatttgacaaatgaaacngcngagagccgagacacgggtctggttgtaacttacgtggtgggaccggggacggggccgtaggttggttaagtttaggggaactttcggtttcggccgggggtaccgtacgggggtaccccg

SEQ ID NO: 362807 - DNA, 603 bp, Homo sapiens
  misc_feature: GZ8MTXP02G1512.15.34.D01.1.454.CMB.2.raw
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatcacagtacaaacactcgcttcgttccggggtcctgactccgcttctctcggctccatccgttagggaaacaaagctcgccctacaccactcggaccggggcccaggcagacgatagaatggtatacttatccgactcgtcgttcctttagtcgggtggggtcgtggtcgttaggtttggggtcggttcgggacgggtaacgggtaaccgaaacgtccggtacccggtcgtacgggtaccgacgtacccgaacggtcccgtccgtcccccgtcggtaccaccgttccgtttccccgg

SEQ ID NO: 362808 - DNA, 601 bp, Homo sapiens
  misc_feature: GZ8MTXP02JKSOO.15.34.D01.1.454.CMB.2.raw
  modified_base (433)..(433): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagcctccacgcacgctcatctacagtacaaacactcgctcgttccgggtcctgactccgcttctctggcctccacttccgtagggaaacaaacgctacgccctcaccactccgaccggggcccaggcagacgatgaatgtacgatttacnctactcgtccgttccgtttagtgggtggggtcggtgggtacgtggtttggggtcggttacgggcggggtaacgggacctaaacggtaccggaccggttaccgtacggtaccaccggacccgaacggccctaccggtcccccgtacggttcctaccttccgtttccccg

SEQ ID NO: 362809 - DNA, 809 bp, Homo sapiens
  misc_feature: GZ8MTXP02J0WS4.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtccgcgtctgtcttctacttacttaacctaaccgtccggccctcggtaccggtccgacgaaccccgaccggccgaccgccgtccccaccgaccgaccgaccgtcctactacctacaacgtaaccgaaaaccaacctacgtccgttaccgttccggggttccccgtcgtagtacctcccgttccttctcggtcgtcctaccttacgttccgggtaaacggaaaacctacgtacgtccccgtcctaaccaccgtaccgtacccgggggaccccgggaccgacgacgaacgaacgtagtaagttcggaggttaacttaacttccgaacccgttacggtccggtttacccgttttacgtttgggggttcgggggtccgggttagggttccggtaaggtttttccgggggttgggggttccgggttaaccgggggaacgggggtaaacccgtaaaaacccggttcggtaaccccgggttacccgttaacgggtacccgaccggacccccggttaaaccgggcccgttcccggtaccccccgtcccgggtttaccaacccgtttccctttcccggtttaacccccc

SEQ ID NO: 362810 - DNA, 600 bp, Homo sapiens
  misc_feature: GZ8MTXP02ISB0Q.15.34.D01.1.454.CMB.2.raw
  modified_base (320)..(320): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttggaggtctggctcagtctctacttctaactacgccgctcggtaccgcacgaccccaggccagcctccacgcacgctcatctacagtaacaaacnctcgcttccgttcccggggtccctgactccgtcttctcgtcgctccattccgtagggaaacaaagcctcgccctacaccagtccgaccggggcccaggcaagtacgatagaatgtagtattactcctacgttcgtccgtttcctttaggtgggtcggggacgtggtcgtaggtttggggtggttcgggacgggtaacggactaaacgtcggtaccgtcgtacggaccacggacccgaacggccgtcccgtcccccgtcggtcctaccgttccttccccgg

SEQ ID NO: 362811 - DNA, 585 bp, Homo sapiens
  misc_feature: GZ8MTXP02GBDN0.15.34.D01.1.454.CMB.2.raw
  modified_base (320)..(320): a, c, t, g, unknown or other
  modified_base (392)..(392): a, c, t, g, unknown or other
  modified_base (443)..(443): a, c, t, g, unknown or other
  modified_base (471)..(471): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtccttctacttctaactacgccgcctggtaccggcacgaccccaggcccagccctccacgcacgctcatcacagtaacaaacnctcgcttccgttccggggtcctgtactcccgtcttctctcggtctccacttccgtagggaaactaaagcctnccctacaccatccggaccggggcccagggcagacgatgaatgtagacttancactgtcttctttagtggtgggcgtcgngttaggttgggtgtcgggcggtacggacctaacgtcgtacgtccgtacggtaccaccggaccgaacggcccgttcccgcccccgttacggtccctccgtttcccgtttaccccg

SEQ ID NO: 362812 - DNA, 644 bp, Homo sapiens
  misc_feature: GZ8MTXP02GIDRT.15.34.D01.1.454.CMB.2.raw
  modified_base (337)..(337): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtgggggtccctgagctctcctgtgcagcctctggattcagttctagtaaatctggatagtggtccgccaggctccgaggggagggctggagtggatggaccaatntagaaaccaaggacggaatgaataaacatcatggtgggctctgtgcgaggggcctattcacttatcctaccaagacgaaccgaaccgacccaaagtaacttacgtaggttagtttaatttggaaacctaaaagttacgaaaaccgtacggtaccctaggaacgaccggacccggaacgaccgaaccgggtcgtaggttacgttagtttacggtggtacggggaccgggggtaacggggcccggtaaggttggttaagtttggtaacgtttaccggtttcgggacgggggaccgtaacgggggttccc

SEQ ID NO: 362813 - DNA, 629 bp, Homo sapiens
  misc_feature: GZ8MTXP02FMLIJ.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccgcacgaccccaggcccacgccctccacgcacgctcatctacagtacaaacactcgcttccgttccggggtcctgactcccgtccttctctggcctccattccgtagggaaactaaagcctcgccctcaccagtcgaccggggcccaggcagacgatagaagtgtagattatcctacgtgtccgtttccgtttagtcgggtggggtcggtggtcgttaggtttggggttcggttccggggacgggtaacgggtaacccgtaaaacgtcggtaacccggttaccggtacgggtaccgaccggtacccgaacggtcccgtacccggcccccgttcgggtacccaccgtttccgttacccccg

SEQ ID NO: 362814 - DNA, 643 bp, Homo sapiens
  misc_feature: GZ8MTXP02JJRBM.15.34.D01.1.454.CMB.2.raw
  modified_base (316)..(316): a, c, t, g, unknown or other
  modified_base (362)..(362): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttggaggtctggctcagtctctacttctaactcgccgcgtggaccgcacgaccccaggccacgccctcaccgcacgctcatctacagtacaaacncctcgtctccgttccggggtcctgactcccgcttctctggcctccntccgtagggaaacaagtcctcgccctcaccacgtccgacccgggggcccaggaccgagacgatagtaactgtagtatttactactacgtcgtaccgtttctttagggtcgggtcgggggtcggttcgggtcgtttagggtttcgggggttcggtttaccggggccgggggtaaacgggtaacccgtaaacggttccggtaaccggttccgttaacgggtaccaccggacccgaacggtcccgtcccggtccccgttacggtacctccgttccgtttccccg

SEQ ID NO: 362815 - DNA, 637 bp, Homo sapiens
  misc_feature: GZ8MTXP02J4AK6.15.34.D01.1.454.CMB.2.raw
  modified_base (346)..(346): a, c, t, g, unknown or other
  modified_base (373)..(373): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagtctgggttttccttgttgctattttagaaggtgtccagggtgaggtgcaggtggtggaatcgtgggggagtcttggtccagccgtgggggtccctgagactctcctgtgcagcctctggattcattctaagtaaatacgtggtataggttcggccgcaggctccggaggggagggctagggagtggatggaccaatnagaaaccaaggacgaatgaactaaacntacgtagtggtcgctgtgcgcgacgtctatccatactcacgaagacaacaacgactaaagtacttacgtagttgttatacgaactaagtacgaacgacgtacgtacggaaccggtaaccgacccggtaacggacgtacggtacgttaggtacgttacgtacggtcggggacggggtacgggggacggtacgggttaggttacgggtttaacgttacgggttaacttccggttaccggggaccggggtaccggtaccgggtaccg

SEQ ID NO: 362816 - DNA, 592 bp, Homo sapiens
  misc_feature: GZ8MTXP02JA8DO.15.34.D01.1.454.CMB.2.raw
  modified_base (370)..(370): a, c, t, g, unknown or other
  modified_base (377)..(377): a, c, t, g, unknown or other
  modified_base (415)..(415): a, c, t, g, unknown or other
  modified_base (451)..(451): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggaggcttggtccagccgtggggggtccctgagactctcctgtgcagcctctggattcagttctagtaaatactggataagttggtccgcaggctccgaggggaaggggctggagtggatggaccaatagtgaaaccagacggaagtgaataaacntcatggnggctctggtgcgagggcctagtcactatctaccagganacaacgcaagatcagtgttattgacaaagtgaaacngacctagacgacggaccgacgacgacggtctggtatacgttacgtcgggaggccgggggaagggcccggtaggttacgggttaagtttagggtaacgtttaccggttttcggggcgggggtacccgtaacgggggttcccg

SEQ ID NO: 362817 - DNA, 675 bp, Homo sapiens
  misc_feature: GZ8MTXP02GNYEA.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccgtgggaggacagtcacactcacttgtgccttggagtctggctcagtctctacttctaactacgccgcctggtaccggcacgaccccaggcccacgccctccacgcacgctcatcctaacaacgtaacaaacactcgtcttccgttccggggtcctgactccgtcttcctcgtacggcctacctacgttccgttacggggaaactaaacggtccttaccgaccccttacacccgaacgtccgggaacccgggggcccaacggacgaaacggaacgacgttagaaaagttggtaacgtatttaactcgtaacgttcggtaccgtttaccgtttaaggtggggtaccgggtgggtacggttaccgttagggtttgggggttacgttcgggggacggtaacgggaaccgtaaacgtacgtacccgtacggtacgtaccgacgaccgaacggcctccggccccctggtacctaccgttcgttaccccg

SEQ ID NO: 362818 - DNA, 590 bp, Homo sapiens
  misc_feature: GZ8MTXP02I9QCX.15.34.D01.1.454.CMB.2.raw
  modified_base (363)..(363): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccttccacgcacgctcatctacagtacaaacactcgctctccggggtcctgctcgctctctgctcactctaggaacaanctcgcctcacactcgaccgggcccagcgagacgatgaagtgtagtattactcacgttgtccgtttacctttaggtgggttcgggggtcggttcggtcgttaaggttttggggtcgggtttcggggacggggtacgggaaacccgtaaacgtccggaccgttaccggtacgtacgaccggaccgaacggtcctcccgcccccgtcggtcctaccgttccgtttccccg

SEQ ID NO: 362819 - DNA, 634 bp, Homo sapiens
  misc_feature: GZ8MTXP02FFZO1.15.34.D01.1.454.CMB.2.raw
  modified_base (317)..(317): a, c, t, g, unknown or other
  modified_base (338)..(338): a, c, t, g, unknown or other
  modified_base (348)..(348): a, c, t, g, unknown or other
  modified_base (438)..(438): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtaccgcacgaccccaggccacgcctccacgcacgctcatctacagtacaaacnctcgcttcgttccgggcctgntcccgcttcnctggcctccattccgtagggaaacaaacgtctcgccctacaccacgtccggaccgggggcccaggcaagacgatcgaatgtagtattacncacgtcgtccgtttctttaggtgggttcgggggtcggttggtacgttacgggtttgggggtcggtttccggggacggggaacggggtaaaccctaaacggttccggtaacccggttaccgtacgggtaccgaccggtaccccgaaacggtcccgtcccggtcccccgttcggtacctccgttcccgtttcccccgg

SEQ ID NO: 362820 - DNA, 545 bp, Homo sapiens
  misc_feature: GZ8MTXP02I3V6Y.15.34.D01.1.454.CMB.2.raw
  modified_base (321)..(321): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtaacaaacacctcnctccttccggggtccctgactccgcttctctggctccatccttagggaacaaacgctcgccctcaccatcgaccggggccaggcagacgatgaatgagattatcactgtcgttcctttagtggtgggcgtggctagtttgggtgttcggcggacggaccaaacgtcgaccgttcgtacgtcacgacccaaggccgtccgcccccgtcggtccaccttcttcccg

SEQ ID NO: 362821 - DNA, 581 bp, Homo sapiens
  misc_feature: GZ8MTXP02F5EF4.15.34.D01.1.454.CMB.2.raw
  modified_base (322)..(322): a, c, t, g, unknown or other
  modified_base (449)..(449): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttgaggtctggctcagtctctacttctaactacgccgcctcggtaccgcacgaccccaggccacgccctccacgccacgctcactctacagtaacaaacnctcgcttccgttccggggtccctgtactcccgtcttcctcgtcggtcctcctactccgttagggaaacaaacgctcgccctcaccacgtccgaccggggccaggcagacgatagagtgtagtattanctacgtcgtcgttcctttaggtcgggtggggtcgtggtcgttaggtttggggtcggtcgggacgggacggtaaccaaacgtcgtaccgtcgtacgcgacgaccgaagcctccgccccgtcgtcactctcccg

SEQ ID NO: 362822 - DNA, 905 bp, Homo sapiens
  misc_feature: GZ8MTXP02FQTJH.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggaggacagtcacactctacgttgtcgtccgttaggacggttcgtcggtcctacgtacgttccttacctttaccttaccttaaaccgttacccggcccgtccgttacgggtacccggacgaaccgaccccgacggacccacgtcccctacccgaaccgccaaccgtctacctacttacctaacctaacgttaaaccaaaaacctcccgtccggtcctttccccgggtttcccggggtcccctgtacgtcccgtccctttcctccgtcggtcccttacccgtaccgtttcccggggttaagggaaaacccgtaaacgtcccgttacccggtaccccccttaacccaacccgtaaccgttacccgggggaacccccggggggaccccgaacggggaccgaaaccgggtaaccgtaacgttacggtaaaacgtttgggtaagttaactttacgtacccgtaacgttccggttacccgtttttacctttaagggttcggggttcgggggtcggttaaccggggtcgttttaaggggtttcgggggttacgggtttccgggggaaacggggtaaaccggggtaaaacccctaaacgggttaccggtacccggttaccggtttaacggggtaccaaccggtaacccggaacgggttcccttaccccgggtaccccccgttcggtaaccctaccgtttcccgtttaacccccgg

SEQ ID NO: 362823 - DNA, 691 bp, Homo sapiens
  misc_feature: GZ8MTXP02FNGPS.15.34.D01.1.454.CMB.2.raw
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagggtgaggtgcaggtggtggaatcgtggggggaggcttggtccaggcccgtggggggtccctggagactctcctgtgcagcctctggattcagttactaagtaaaactacgtgggaataaggttcgggtccccgccgaaggcctaccggagggggaacggggctggggaggtggagtcggacccaaagtagtacgaaaccgaaaggaacggaagtagaacttaaacgatacgatggtgggtcctcgtggtcggaccgacgggggtcccgtattaccctaattactccctaccgaagtaacgaaaccaaaccgcctaaaagtaactcgttaaagtgttaatttcgaacaaaagtgaaacacgtcctaggaagacgaccggaacgacgacgcgttaggttactacgttactgggtacgggacgggggtacggggaccggttggttaggttaagtttaggggacttttaccgggttcggtacggggggacccgtacgggggtaccccg

SEQ ID NO: 362824 - DNA, 575 bp, Homo sapiens
  misc_feature: GZ8MTXP02H8QF0.15.34.D01.1.454.CMB.2.raw
  modified_base (396)..(396): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtccctgggagggacagtcacactcacttgtgccttgaggtctggctcagtctctacttctaactcgccgctggtaccggcacgaccccaggccacgcctccacgcacgctcatcctacagtaacaaacactcgctcgttccggggtccctgactccgcttctctcggctccatccttagggaaacaaacgcctcgccctcacccanccgaccggggcccaggcagacgatgaatgtgattatcactgtcgttacctttagtggtggggcgtggtcgtaggtttggggtggttcggggacgggtaacgggaccaaacgtcgacccgttcgtacggtcacggacccgaacggccgtccgcccccgtcggtacctacttccgttcccg

SEQ ID NO: 362825 - DNA, 597 bp, Homo sapiens
  misc_feature: GZ8MTXP02JJNG6.15.34.D01.1.454.CMB.2.raw
  modified_base (217)..(217): a, c, t, g, unknown or other
  modified_base (234)..(234): a, c, t, g, unknown or other
  modified_base (257)..(257): a, c, t, g, unknown or other
  modified_base (288)..(288): a, c, t, g, unknown or other
  modified_base (352)..(352): a, c, t, g, unknown or other
  modified_base (389)..(389): a, c, t, g, unknown or other
  modified_base (397)..(397): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacagtcacactcacttgngccttgaggtctggctnagtctctacttctaactacgccncgtggtacccggcacgaccccaggccagccnccacgcacgctcatctacagtacaaactctcgtctccgttccgggtccctgactcccgtcttcnctcgcctcatccgtagggaaacaagcctacgcccctnacccgacncgaccgggggccaggccaagacgagtagatgtagtattatacacgtcgtccgttactttaggtcgggtgggtcggtcggtacttgggtttgggttcggttcggggacggtaacgggacctaaacgtccgtaaccgtccgttacgaccgacgacccgaacggttcccgacccgtacccgtcgtacctaccgttccgtcccg

SEQ ID NO: 362826 - DNA, 597 bp, Homo sapiens
  misc_feature: GZ8MTXP02F0K1Y.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgcctggtaccgcacgaccccaggcccagccctccacgcaccgctcatcctaacagtacaaactactcgcttccgttcccggggtccctgactcccgtccttctcgtcggcctccacttccgtagggaaacaagcctcgccctcaccatcgaccgggggcccaggcagacgatagtaatgtagattagtcctacttcggtccgtttcctttaggtgggtcggggtcgtggtcgttaggtttgggtcggttcgggacgggtacggaacaaacggtcgtacccgtcgtacgtccgacgtacccgaagtcccgacgtcccccgtacgtctacgttcctcccg

SEQ ID NO: 362827 - DNA, 634 bp, Homo sapiens
  misc_feature: GZ8MTXP02FN80K.15.34.D01.1.454.CMB.2.raw
  modified_base (265)..(265): a, c, t, g, unknown or other
  modified_base (543)..(543): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttagaaggtgtccagggtgaggtgcaggtggtggaatcgtgggggaggcttgggtccagccgtggggggtccctgagactctcctgtgcagcctntggattcagttctagtaaatactggataaggtgggtccgccaggctccgaggggaagggctgggaggtggagtggaccaaagtatacgaaaccaaaggacggaagtagaataaacatcagtggtgggctctggtgcgaggggccgtattccactatcctaccgaaggacgaacgaaacgaccaaagtaacttcgtagtgttaaatttcggaacaaaatcggaaactacggcctaaggagacggcccgaacgaccgacgggtctggtagttacttacgnggtacgggcgggggtacggggaccggtaggttaggttaagtttaggtaactttacggtttcggacgggggacccgtacgggggtaaccccg

SEQ ID NO: 362828 - DNA, 557 bp, Homo sapiens
  misc_feature: GZ8MTXP02FE6WZ.15.34.D01.1.454.CMB.2.raw
  modified_base (348)..(348): a, c, t, g, unknown or other
  modified_base (425)..(425): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttcaactacgccgcctggtaccggcagaccccaggccagccctccacgcacgctcatctacagtacaaaacactcgctcttccggggcctgactccgcttcnctggctccatccgtagggaaacaaagctgccctcaccatccgacgggggcccaggcagacgatgaaatgtagattancactcgtcgttctttagtggtcgggtcgtggtcgttaggtttgggtggtacgggacgggacgggtaaccaaacgtcgaccgtacgtacgtcgacgaccgaacgccgtccgccccgtcgtccacgtccgtccg

SEQ ID NO: 362829 - DNA, 583 bp, Homo sapiens
  misc_feature: GZ8MTXP02I7JMG.15.34.D01.1.454.CMB.2.raw
  modified_base (349)..(349): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcggactgtggtgacccaggagccatcgttctcagtcgtcccctgggagggacagtcacactcacttgtgccttgaggtctggctcagtctctacttctaactacgccgcctggtacccggcacgaccccaggccacgccctccacgcacgctcactctacagtacaacactcgcttcgtccgggtcctgactcgcctntctgctcattccgttgggaaacaagtcctacgccctacaccagtccgaccggggcccaggcaaggacgagtgaatgtagattatctactcgccgtttctttagtgggtagggcggtacggtgttaggtttgggtggtttggacgggaacggtaccaaacgtcgtaccggtacgtacggtacacggaccgaacggccgtccgccccgttcggtcctacctccgttaccgtccccc

SEQ ID NO: 362830 - DNA, 571 bp, Homo sapiens
  misc_feature: GZ8MTXP02F1F1U.15.34.D01.1.454.CMB.2.raw
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccacgccctccacgcacgctcatcacagtacaaaacactcgctccgttccggggtcctgactccgtcttctctcggcctccatccgtagggaaacaaagctcgccctcacccacgtccgaccggggcccaggcagacgatgaatgtagattatcactgtcgttcttagtggtggggcgtggtcgtaggtttgggtcggttcgggcgggacggtaaccgaaacgtcgtaccggtacgtacggtcgacgtacccgaaggcctccgccccgtcggtccacgttcttcccg

SEQ ID NO: 362831 - DNA, 731 bp, Homo sapiens
  misc_feature: GZ8MTXP02IMWKU.15.34.D01.1.454.CMB.2.raw
  modified_base (254)..(254): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaacncgccgctcggtccggcacgaccccaggccacgccctccacgcacgctcatctacagtacaaacactcgtctccgttccgggtcctgactcccgtcttcctctcggtccttcccattccgttagggaaaccaaacgccgttccgacccctccaacccacgtaccggacccgggggcccacgggccaaggacgaagtagaaacgttggtagtaactttactccgtaacgttccgttaccgtttacccgtttttacggtggggtttcgggggcggtttcggggtaccgttagggtttttcgggggttcggggtttccggggaacgggggtaaccggggtaaaaccccgttaaaaccggtacccgggttaacccggttacccggttaaccgggttacccgaccggaaccccggtaaacgggtcccgttccccgggtcccccccgttcggtaaccccgtacccgttttccgtttccccccgg

SEQ ID NO: 362832 - DNA, 570 bp, Homo sapiens
  misc_feature: GZ8MTXP02I1EK3.15.34.D01.1.454.CMB.2.raw
  modified_base (423)..(423): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccgcacgaccccaggccagcctccacgcacgctcatcacagtacaaacactcgctcgtccggggtcctgactcgcttctctggctccatccgtagggaaacaaagctcgccctcaccatcgaccggggccaggcagacatgaatgtagattacnctactgtcgttcttagtggtcgggcgttggacttggtttgggtacggttcgggacgggtacgggaacctaacgtcgtaccgtcgtacggtaccgacgacccgaaggtccgtccgtcccccgtacggtcctaccgttccgtttccccg

SEQ ID NO: 362833 - DNA, 668 bp, Homo sapiens
  misc_feature: GZ8MTXP02HM12W.15.34.D01.1.454.CMB.2.raw
  modified_base (295)..(295): a, c, t, g, unknown or other
  modified_base (302)..(302): a, c, t, g, unknown or other
  modified_base (314)..(314): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccctgggaggacagtcacactcacttgtgccttgaggtctggctcagtctctacttctactacgccgctcggtaccgcacgaccccaggccagctccacgcacgcncatcaanacgtaacaaacnctccgcttccgttcccggggtcctgactccgtccttctcgtcggcctccattccgttagggaaacaaacgcctcgcccctacacccgactccggacccgggggcccacggcgaacgacgaagtgaatcgtagtacttacgtctacgttcgttcgttaccgtttaggtcgggtcggggtcggttacggtcgttagggtttcggggttcgggtttacggggaccgggggtaacggggtaaaacccgtaaacggttaccggtacccggttaaccgttacggggtccgaaccggacccggtaaacgggtcccgtaccccgtccccggtcccggtcctacccgtttccgtttcccccgg

SEQ ID NO: 362834 - DNA, 532 bp, Homo sapiens
  misc_feature: GZ8MTXP02FOJNJ.15.34.D01.1.454.CMB.2.raw
  modified_base (346)..(346): a, c, t, g, unknown or other
  modified_base (375)..(375): a, c, t, g, unknown or other
  modified_base (523)..(523): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggcctgatccgcttcnctgctccatcctgggacaaagctgccctnaccatcacgggggcccaggcagacgatgaatgtgattatcactgcgttcctttatgttggggcgtggctagtttgggtgttcgggcggtagggaccaaaacgtcgaaccgtcgtacggtcagcccgaaaggcctcgccccctggtacnctcttcccg

SEQ ID NO: 362835 - DNA, 707 bp, Homo sapiens
  misc_feature: GZ8MTXP02GWDKJ.15.34.D01.1.454.CMB.2.raw
  modified_base (373)..(373): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactcacttgtgccttggaggtctggctcagtctctacttctaactacgccgcctcggtaccgcacgaccccaggccacgccctcacgcacgctcatctacagtacaaacactcgctccgttcccggggtcctgactccgtcttcctcgtcggtcctcccncgttccgttagggaaaactaaacgcctaccgtccctaccaaccctacgtacccggacccgggggacccgacgggcaagacgagtagaaagtgtacgtattaactccgtacttcggtaccgtttccgtttaggtgggggttcggggcggttgggtacgtttacgggtttggggttcggggtttacggggaccgggggtaaaccgggtaaacccgtaaaaccggttccgggtaaaccccggttaccggtaaccgggtacccgaaccggtaccccgaaacggtccccggtcccgttacccccccggtcgttaccccgaccctttcccgtttcccccg

SEQ ID NO: 362836 - DNA, 629 bp, Homo sapiens
  misc_feature: GZ8MTXP02IOWEF.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactggtggtcgacccaggagccatcgttctcagtcgtccctgggaggacagtcacactctacttgtcgccttgacggtctggctcagtctctacttctaactcgccgctcggtaccgcacgacccgacgccacgcctccacgcacgctcatcacagtaacaacactcgctcgtacccggggtcctgactccgtcttctcgtgcctccactccgtacgggaaacaaacgctacgccctacaccacgtccgggaccgggggacccagggaccgaaggaaccgtagtagtaagttcgtagtatttaacgtccgacgttccggtcgttacccgttttagggtgggttcgggggtcgtgggttcgttagggttttggggtacggttcggggacggtaacgggaacctaacggtcgaccgttcgtacgtcgaccgaccgaacgtaccgtccgtccccgtacggtccctacttccgtccccg

SEQ ID NO: 362837 - DNA, 596 bp, Homo sapiens
  misc_feature: GZ8MTXP02GEN41.15.34.D01.1.454.CMB.2.raw
  modified_base (435)..(435): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctcttacttactaactaccgccgtccgtcggtaccgcacgaccccgaggccacgccctccacgccacgctacactctacagtaacaaaacactagcttccgttccggggtcctgactcccgtcttctctcgcctccattccgtagggaaacaaacgtcctcgaccctcaccacgtccgaccggggccaggcagacgntacgatgagtattatcatcgtcttcttaggtggtcggtcgtggtcgttaggtttggggtcggttacgggacgggacggtaacctaacggtccgtaccgtccgtacgtacgacgacccgaaggtccctcccgtaccccgtcgtacctacgttccgttccccg

SEQ ID NO: 362838 - DNA, 675 bp, Homo sapiens
  misc_feature: GZ8MTXP02HR67J.15.34.D01.1.454.CMB.2.raw
  modified_base (294)..(294): a, c, t, g, unknown or other
  modified_base (486)..(486): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggacgccattcgttctcagtcgtcccgtgggagggacagtcacactctacttgcgtccttggaggtctggctcagtctctacttctaactcgccgcgtggaccgcacgcccaggccacgccnccacgcacgctcactctaacagtaacaaaactcgtcgccttccggttccggggtccctgacttccgctttcctcgtacgtctcctagttccggttagggaaaaccacggtcctccgtaccctacacccgacgtacccgggacccgggggcccaacgggtacaacggacgtagtagtaagtgtagtacttacncgtactcgtttccgtttacgtttggtgggtcggggtcggttcggtcgttacgggtttggggtcggtcggggacgggtaaccggaaccgtaaacggtccggtaccggttaccgtacgggtaccaccggaccgtaacggtccccgtacccggtccccgtacggtttccctaccgtttcccggtttcccccg

SEQ ID NO: 362839 - DNA, 558 bp, Homo sapiens
  misc_feature: GZ8MTXP02HXAKN.15.34.D01.1.454.CMB.2.raw
  modified_base (235)..(235): a, c, t, g, unknown or other
  modified_base (318)..(318): a, c, t, g, unknown or other
  modified_base (339)..(339): a, c, t, g, unknown or other
  modified_base (435)..(435): a, c, t, g, unknown or other
  modified_base (480)..(480): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctnagtctctacttctaactacgccgcctggtaccgcacgaccccaggccagcctccacgccacgctcatctacagtaacaaaacnctcgctcgttccggggtcccngactcgcttctctgctccagtccttagggaaacaaagcctacgccctacaacccatccgaaccgggggcccaggccaagtacgataggaatcgtanattatcatgtcgttcttagtggtgggctggctgtttggtgtcggnggtacggacccaaagtcgtacgtaccagggtacacggaccgaacggcctccgcccctcggtacctccgtctttcccgg

SEQ ID NO: 362840 - DNA, 607 bp, Homo sapiens
  misc_feature: GZ8MTXP02JGVDB.15.34.D01.1.454.CMB.2.raw
  modified_base (307)..(307): a, c, t, g, unknown or other
  modified_base (375)..(375): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtcgtccccgtggagggacagtcacactctacttgtgtccttgaggtctggctcagtctctacttctaactacgccgctggtaccgcacgaccccaggccacgcctccacgcacgctcatcanatacaacactcgctcgtccggggtcctgctccgtcttctctggctccactccgtagggaacaaagccncgccctcaccactcgaccggggcccaggcagacagtagaatgtagtattatcctagtcgttcgttcctttaggtcggtggggtcggtagtcggttagtttggggtcggttcgggacgggtacgggaaccgtaacgtaccggtaccgttcccgtaacggtccgaaccggtacccgaacggtcccgtcccggtcccccggttaccggtaccctaccgtttcccgtttcccccgg

SEQ ID NO: 362841 - DNA, 764 bp, Homo sapiens
  misc_feature: GZ8MTXP02HMGFP.15.34.D01.1.454.CMB.2.raw
  modified_base (219)..(219): a, c, t, g, unknown or other
  modified_base (304)..(304): a, c, t, g, unknown or other
  modified_base (315)..(315): a, c, t, g, unknown or other
  modified_base (335)..(335): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtcgacccaggagccatcgttctcagtcgtcccgtgggaggacagtcacactcacttgngccttgaggtctggctcagtctctacttctaactcgccgctggtaccgcacgaccccaggccagccctcacgcacgctcatctanagtaacaaacnctcgctccgttccgggtccngtacgtccccgtcttcctcgtcggtaccttccgtaagttcccgttaaggggaaactaaacgggtcccttaccgaccccctacaacccgacgttacccgggacccgggggcccaacgggttaccaaggtaccgagtacgtaaacgtcgggttagtaactttaactccgtaacgttcggttaccgtttccgttttaagggtccgggggttcgggggtcgttacgggtaccggttttacggggtttcgggggttaccggtttccgggggaaacggggttaacccgggtaaaacccgttaacgggtaccgttacccccgggttaacgtttaccggggtacccgtaaaccggaccccggaaacgggttcccgtaccccccggggtacccccgttcgggtacccccttaaccggtttccccggtttacccccccg

SEQ ID NO: 362842 - DNA, 676 bp, Homo sapiens
  misc_feature: GZ8MTXP02GOJ03.15.34.D01.1.454.CMB.2.raw
  modified_base (263)..(263): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagttcgtccccgtggagggacagtccacactcacttgtgccttgaggtctggctcagtctctacttactaactaccgccncgtcggtaccggccacgaccccaggccacgcccgtccacgccacgctcactctacgaagtaaccaaacactccgtccttccgttcccggggtcccctgactcccgtcttctcgtacggtcctcctaacgtccgttagggaaactaaacgctccgacccctacaccacgtcggaacccgggggcccgacggcgaacgtaacgagtagaaattgtagaattactactacgttcgtacgtttccgtttaggttgggtccggggttgtcgggtacgtttagggttttcggggtcgggtttacgggacggggtaacgggtacccgtaaaacggtccgtaaccgtaccgtacggtaccgtacggaccccgtaaggtcccctccgggtccccctacggttaccaccttccctttaccccg

SEQ ID NO: 362843 - DNA, 549 bp, Homo sapiens
  misc_feature: GZ8MTXP02FPO4A.15.34.D01.1.454.CMB.2.raw
  modified_base (423)..(423): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgttccggggccctgactcccgcttctctggctccatcctgggaaacaaagctcgccctacaccatcgaccgggggcccaggcagacatgaatgacgattancactgcgttctttagcggtggggcgtggctagtttggggtcgttcgggacggacgggaccaaagtcggacccgtccgtacggtacacgacccaacggcctccgccccgtcggtcaccgtcttcccg

SEQ ID NO: 362844 - DNA, 922 bp, Homo sapiens
  misc_feature: GZ8MTXP02I1OLS.15.34.D01.1.454.CMB.2.raw
  modified_base (305)..(305): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattgggctgagctgggttttccttgttgctattttagaaggtgtccagggtgaggtgcgaggtggtggaatcgtgggggagcttggtccagccgtgggggtccctgagctctctgtgcagcctcgtggattcagttctaagtaaatacgtggataaggttcgggtccnccgaggcctccgaggggaaggggctgggagtggagtcgggaccctaagtactacggaaaccctaaggaaacgggtaagttacgaaactaaaaccgataccgtaagttcgggttacggggccttacgttcgggttacgaccggtaacgggggtacccccggttaaatttttaccccgaaaccttaacgttttcccccgaaacccgtaaagggtaaacccgaaaaccccgaaaacccggttaacccccgaaaaaggggttaaaacctttccggtttaaaggtaggtttttaaacgttttaacgggaaaaccctttaaaaaggttacgtaaaacccggaccgggttaccccgttaaaggggaacggaaacccgggtccccggaaaacccggttaccggaacccgggggtttcctttacggggtttaaaacgtttacgtttttaaaacccggggttgggggtaaacccgggggccggggggttaaaccgggggtccccgggggttaaggttttttaccggttttaaaaggtttttcgggggaaaaccgtttttcccggggtttttaacccgggggcccggggggttaacccggttaaccccgggggggtttaacccccccg

SEQ ID NO: 362845 - DNA, 628 bp, Homo sapiens
  misc_feature: GZ8MTXP02GQHCG.15.34.D01.1.454.CMB.2.raw
  modified_base (288)..(288): a, c, t, g, unknown or other
  modified_base (458)..(458): a, c, t, g, unknown or other
tcagtctacgtagccacgaccggtgctcgatttagatcgtctgtgttgggggttgggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtcgtccttgaggttctggctcagtcctctacttactaacgtaccgccgcctcggtaccgcacggaccccncggccacgcctccaccgcacgctcactacacacgtaacaaacctcctcgtccttccgtcccggggtcctagtctccccgtcttctcgtcgcctccacttccgtaagggaaacaacgtctaccgcctacaccacgtccgaccggggcccaggcaagacgagtagagtgtanagttactacacgtcgtccgttacgtttaggtgggtcgggtcggttcggtacgttaggtttgggggtcgttacgggggcgggtaaacggaaccgtaaacgtcggtaccgtacggtacgtcgaaccgtaccgaacggtccgtccgccccgtgtacctccgttccgttccccg

SEQ ID NO: 362846 - DNA, 683 bp, Homo sapiens
  misc_feature: GZ8MTXP02FOQWQ.15.34.D01.1.454.CMB.2.raw
  modified_base (372)..(372): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtcgacccaggagccatcgttctcagtcgtccccgtggagggacagtcacactctacttgtgtccttggaggtctggctcagtctctacttctaactacgccgcgtcggtaccgcacgaccccgagccacgcctaccacgccacgctcatctaacaagtaaccaaaacactccgcttccggttcccggggtcctgtactccgtcttcnctcggtcctccacttccgtaagggaaacaaaggtcctcgccctcaacctagtaccgggacccgggggcccaggccgaaaggaccgagtagaagttgtagtaactttactaccgtaagttcggtttaccgtttaccgttttaagggtcggggttcgggggtcgttacgggttcgtttaaggggtttcgggggttacgggtttcgggggaacgggtaacgggaaacccgtaaaacgtccggtaaccgttccgtaacggtacaccggtaccgaacggtcctacccggcccctcggtaccaccttccgttccccg

SEQ ID NO: 362847 - DNA, 566 bp, Homo sapiens
  misc_feature: GZ8MTXP02JC5HA.15.34.D01.1.454.CMB.2.raw
  modified_base (325)..(325): a, c, t, g, unknown or other
  modified_base (355)..(355): a, c, t, g, unknown or other
  modified_base (417)..(417): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcactttgtcgcctttggaggtctggctcagtctctacttctaactacgccgcctggtaccgcacgaccccaggcccacgccctccacgcacgctcatctacagtacaaacnctcgctcgtccgggtccctgctccgcttcnctcggctccatccgttaggaactaagcctgccctcaccactcgaccggggccaggcagacanagaatgagtatagtccacgtcgtcgttcctttagtggtggggcgtggtcgttaggtttgggttcggtcgggcggtaccgggaccaaacgtcgaccgtcgtacgtcacgcccgaagcctacgccccgtacggtcctaccgtcgttccccg

SEQ ID NO: 362848 - DNA, 578 bp, Homo sapiens
  misc_feature: GZ8MTXP02JV5WH.15.34.D01.1.454.CMB.2.raw
  modified_base (362)..(362): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctgtaccgcacgaccccgaggccagcctccacgcacgctcatctaacagtaacaaacactcgctcgttccggggtcctgtatcccgtcttcctcgtcggctaccncttccgttagggaaacaaacgctcgccctacaccactcgaccgggggcccaggacagacgatgaatgtacattatcacttgcgttctttagtggtgggtcgtggtctaggtttggggtgttcgggacggacggtacccgaaatcggaccgtccgtaacggtccgtacgacccgaaggtcccgtccgtcccccgtacggtccacccgttcgttcccg

SEQ ID NO: 362849 - DNA, 665 bp, Homo sapiens
  misc_feature: GZ8MTXP02IMB2A.15.34.D01.1.454.CMB.2.raw
  modified_base (283)..(283): a, c, t, g, unknown or other
  modified_base (297)..(297): a, c, t, g, unknown or other
  modified_base (315)..(315): a, c, t, g, unknown or other
  modified_base (349)..(349): a, c, t, g, unknown or other
tcagtctacgtagccacgaccggtgctcgatttagatcgtctgtgttggggttgggaagcctgagaacacttagccttcatgagtgtccccacatggcctggatgattcttctcctcggactccttgcttatggatcaggagtggattctcagactgtggtgacccaggagccatcgttctcagtcgtcccctggagggacagtcacactcacttgtgccttgaggtctggctctagtctctacttctaactacgccgctcggtacgcacgacccgcgccacncctccacgcacgcncatcgacagtacaacacncgtcttccgtccgggtccctgactcgtccttacnctcggacctccacttccgttaggggaaacaaagtccgtccacccctcaaccgacgtaccggaccgggggacccagggacagaacgtagtagtaaagttcgtaatacttactacctacgtacggtccgttttaccgtttaggttcgggggcgggggttccgtacgggtcgtttagggttttcgggggttgggttacggggtaccggggaacggtaaaccgtaaacgttccgaacccggttcgacgttccgaccggtacccgaacggtccgtccccgtcccccggttcgtaccctccgttccgttcccgtccccccgg

SEQ ID NO: 362850 - DNA, 629 bp, Homo sapiens
  misc_feature: GZ8MTXP02GSQA2.15.34.D01.1.454.CMB.2.raw
  modified_base (322)..(322): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgctcggtaccggcacgaccccaggccacgcctccacgcacgctcactctacagtaacaaacnctcgctccgttccggggtcctgactcccgtcttctcgtcggtcctccactccgttagggaaacaaaggtcctcgccctcaccacgtccggaccggggcccaggacagacgatacgaatgtagtattactctacgtcgtccgttccgtttaggtgggtcggggtcgtggtcgttaggtttcggggttcggttcggggacgggtaacgggtaaccgtaaacgtcggtacccgtaccgttacggtaccgacggacccgtaacggtccgtacccggtcccccgtacggtacctaccgtttccgttaccccg

SEQ ID NO: 362851 - DNA, 617 bp, Homo sapiens
  misc_feature: GZ8MTXP02FKH9D.15.34.D01.1.454.CMB.2.raw
  modified_base (325)..(325): a, c, t, g, unknown or other
  modified_base (351)..(351): a, c, t, g, unknown or other
  modified_base (361)..(361): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtcgacccaggagccattcgttctcagttcgtccccgtggagggacagtcacactctacttgtgccttgacggtctgctcagttctctacttctaactaccgccgcgtcggaccgcacgaccccgagccacgcctcacgcacgctcactcacatacaaacnctccgtcttccgtccgggtctgtacnccgtcttccntcgtcctccagttccgtaggaaacacgccgtcaccctacaccacgtaccgggacccggggacccgaggacacgtaacgatcggaaattgacgttattactcgtacgttacgtccgtttacttagtgggtcgggtgtgtcgttaggttgggtcggtacggacgggtaaccggtaccgaaccgttcggaccttacgtacggaccaccgtaacccgaacgtcccgtccgtcccccgtacgtacgtccgtcctttacccg

SEQ ID NO: 362852 - DNA, 658 bp, Homo sapiens
  misc_feature: GZ8MTXP02JXNKN.15.34.D01.1.454.CMB.2.raw
  modified_base (226)..(226): a, c, t, g, unknown or other
  modified_base (318)..(318): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgagtntggctcagtctctacttctaactacgcgcctggtaccgcacgaccccaggccagccctccgaaccgcaccgctcatcgaacaagtaaaaccnctctctcgtccggtctgctcgtccttctcgtcgcctactacgtcgtacggaaacaagtcctcaccctacacgtacgccggaccggggacctaggacgacggtactagtagaattgtattacttactacgtacgttcgttccgttacgtttagggtcgggttaggggtcgttacggtacggttaggttttcggggtcggttacggggtaaccggtaaacggtaaaccgtaacggttaccggtaccggttaccgtacggtacccgaccggtacccgtaccggtcccggtaccccgtacccccggttcggtacccttaccgttacccgtttccccgtcccccg

SEQ ID NO: 362853 - DNA, 652 bp, Homo sapiens
  misc_feature: GZ8MTXP02F5STZ.15.34.D01.1.454.CMB.2.raw
  modified_base (336)..(336): a, c, t, g, unknown or other
  modified_base (473)..(473): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtcgacccaggacgccattcgttctcagtcgtccccgtgggagggacagtcacactcacttgtgtccttggaggtctggctctagtctactacttactaactaccgccgccgtggtacccgcacgaccccgaggcccacgccctccacgcacgctcactcctaacagtaacaaacncctcgccttaccgttccggggtcctgactcccgtctctctgcctccatccgtaggaaacaagtcctccgaccctacacccgagtccggacccggggcccaggacaacggaacgtagtaggaagtgttacgatttacncctacgttcgttccgtttaccgtttagggtcgggtcggggtgtacggtcgtttaggggtttcgggtcgggttcggggaacggtacgggtaaacccaaacggtcggtaacccgttcgtacggtacaccggaccgtaacggtcctacccgtccccgtacggtcctaccgttcttcccccgg

SEQ ID NO: 362854 - DNA, 706 bp, Homo sapiens
  misc_feature: GZ8MTXP02I59T1.15.34.D01.1.454.CMB.2.raw
  modified_base (351)..(351): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggacgcctatcgttctcagtcgtcccgtggaggacagtcacactcacttgtcgtccttggaggtcctggctcgtagttctacttacttacctaaactaccggcccgtccgtcggtaccggcaccgacccccgaggccacgccctccaccgcaccgctacactacctaacaaaacgtaaaaccncgtcccgtcctcccggttaccccgggtccctgactccgtccttcgtccgtcgcctacacgttccgtagggaaaccaacgtcctaccgcccctacaccgacgtcccggaccggggccaggtcgagacgtagtagtagtcgtagtacttatcctacgtcgttcctttacgtttaggtcggggtcggggtccgttgggtaccgttgggggttttcgggtcggggttaccggggacggggtaaacgggtaaaccctaaacggttccgtaccggtaccgtacgggtacccgaaccggacccgtaacggtccgtcccccggacccgtcggtacctaccgttccggtttccccgttcccccg

SEQ ID NO: 362855 - DNA, 630 bp, Homo sapiens
  misc_feature: GZ8MTXP02I3UVA.15.34.D01.1.454.CMB.2.raw
  modified_base (480)..(480): a, c, t, g, unknown or other
  modified_base (492)..(492): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccattcgttctcagtcgtcccctggaggacagtcacactcacttgtcgccttgagtctggctcagtctctacttctaactacgccgcctggtacccgcacgacccccaggcccacgcccctccacgccacgctcactctaacagttaaccaaaactcctcgcttccgttcccggggtccctagtactcccgtccttcctactcgcttcccattcccgtagggaaaccaaaggtcctaccgccctacacccgactaccggacccggggcccaggcccagacgtataggattgagtattatctatcggtnttaccgtttagngggtcgggacgtgacgttgtttgggacgttcggcggggtaaacgaccgtaaactcgggtaccgtacgtacgggtaccaccggacccgaaagggtccctaccggtccccccttacggtcccgtaccttcgtttcccccg

SEQ ID NO: 362856 - DNA, 623 bp, Homo sapiens
  misc_feature: GZ8MTXP02FXG9P.15.34.D01.1.454.CMB.2.raw
  modified_base (378)..(378): a, c, t, g, unknown or other
  modified_base (386)..(386): a, c, t, g, unknown or other
  modified_base (402)..(402): a, c, t, g, unknown or other
  modified_base (433)..(433): a, c, t, g, unknown or other
  modified_base (450)..(450): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccgaggagccattcgttctcagtcgtcccgtggagggacagtcacactctacttgtcgccgttggacggttctggctcagttcttcttacttctaacgtccgccgtccgtggtacccgcaccggacccctaggccacgccctaccacgccacgctcatcctaacagtaaccaactactcgctttacccggtccgggtcctgactccgtcttcngtcgctcntcgtaggaacagctcncctcactacgcggaccgggccaggcagacgngtgaatgtagtattacnctacgtcgtcgtttaccgttagggtcgggtacggggtcgtagggtcgtttagggtttcgggtcggttccggggacggtacggaaccgtaaacggtcgtaccggttacgtacggtacgccggtaacgaacggtcccgtcccgtaccccggtgtcctaccgtttccgttcccccg

SEQ ID NO: 362857 - DNA, 663 bp, Homo sapiens
  misc_feature: GZ8MTXP02G7IHM.15.34.D01.1.454.CMB.2.raw
  modified_base (279)..(279): a, c, t, g, unknown or other
  modified_base (339)..(339): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcagggagtggattctcagactgtggtgacccaggagccatcgttctcagtcgtcccctggaggacagtcacactcacttgtgccttgagtctggctcagtctctacttctaactacgccgctggtaccgcacgaccccnggccacgcctccacgcacgctcatcacagtaacaaacactcgctccgttccggggtcccngtactccctcttcctctggcctccacttccgtagggaaactaacgctccgcctacaccacgtccggaccggggcccaggcgagacgacgtgaagtgtagtattacgtctaacgtcgttccggttaccgtttaggtggggttcgggggtcgttcggggtcgtttagggtttgggggttacggtttcgggggaccggggtaaacggggtaaccccgttaaacggtaccggttacccggttaacccggtacgggtaccgtaaccggacccgtaacggtcccgtacccgtcccccgttacccggtcctaccgttcccgtttcccccgg

SEQ ID NO: 362858 - DNA, 917 bp, Homo sapiens
  misc_feature: GZ8MTXP02H3NHN.15.34.D01.1.454.CMB.2.raw
  modified_base (302)..(302): a, c, t, g, unknown or other
  modified_base (320)..(320): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtccctgggagggacagtcacactcactttgtgccttgaggtctggctcagtctctacttctactacgcgctggtaccgcacgaccccaggccacgcctccaccgcaccgcncatctacagtaacaaacncctacgtcctccgttcccggggtcccctcgtacgttccccgtcctttccgtccgtacggtcctaccccgtactttcccgggttacgggtaaaaccgtaaacggtccccttcccggtacccccttaccgaaaccccctaaccggtcccggggaaccccggggggggaccccccgaaacgggggacccgaaacggggaaacccggtaacggttaacggtaaaacgtttacgggttaagttaaacggtttttaaaccttaacccccggttaaccgttttacccgggtttcccccgggttttttaccccgttttttaaaggggtttcgggggttacccggggggttcggggtttacggggttccggttttaaagggggttttttaccggggggtttcgggggtttacccggggggtaccgggggttaaaaccgggggaaaaccccggttaaaaaaccggtttcccggggtaaaccccgggttacccggttaacgggtacccgtaaaccggtaccccgggtaaaccggtaccccggtaaccccgggttcccccccggtttaccggttaccccggtaacccctttaccccgtttaccccccgg

SEQ ID NO: 362859 - DNA, 647 bp, Homo sapiens
  misc_feature: GZ8MTXP02GANZX.15.34.D01.1.454.CMB.2.raw
  modified_base (281)..(281): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtcgtcccctgggagggacagtcacactcacttgtgccttgaggtctggctcagtctctacttctaactcgccgctggtaccgcacgaccccnggccagcctccacgcacgctcatcacagtaacaaactactcgccttccgttcccggggtccctgtactcccgtcttctctcggctcctagttccgtaggggaaactaacggcctccgccctcaccacgtccgaccgggggcccaggcaagacgatacgaagtgtagtaattactcctacgttcgtccgtttaccgtttagggttcgggtggggtccggttggccgtttaagggtttcgggggttacggtttcgggggaccgggtaacgggaacccgtaaacggtccggtacccggtacgtaccggtaccgaccggtacccgaacggtccgtcccgtccccgtcggtcctaccgtcctttacccccg

SEQ ID NO: 362860 - DNA, 621 bp, Homo sapiens
  misc_feature: GZ8MTXP02G3VV1.15.34.D01.1.454.CMB.2.raw
  modified_base (287)..(287): a, c, t, g, unknown or other
  modified_base (299)..(299): a, c, t, g, unknown or other
  modified_base (317)..(317): a, c, t, g, unknown or other
  modified_base (362)..(362): a, c, t, g, unknown or other
  modified_base (404)..(404): a, c, t, g, unknown or other
  modified_base (458)..(458): a, c, t, g, unknown or other
tcagtctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatcgtgggggagcttggtccagccgtggggggtccctggagacctctcctgtgcagcctctggattcagttctagtaaatngtatagtggccncaggctcgaggggacggntggagtggatcggcaaatagcgaaacgagacggatcgaataaacntcagtggtagggctcgtgtcggcgacggggctattcaccttntaccacaagacgaactaacggacctaaagacttacgtagttgttatttcgaaanaagttacgaaaacgtcggtaactggaacgacggaccggtaacgacgtacggtcgtagggttactaagttcggtgggcggggaccgggggagggtaccggtaggttgggttaagttccggtaagttccggtttacggacggggttacccgtacggggttacccg

SEQ ID NO: 362861 - DNA, 599 bp, Homo sapiens
  misc_feature: GZ8MTXP02JB3XK.15.34.D01.1.454.CMB.2.raw
  modified_base (308)..(308): a, c, t, g, unknown or other
  modified_base (319)..(319): a, c, t, g, unknown or other
  modified_base (323)..(323): a, c, t, g, unknown or other
  modified_base (395)..(395): a, c, t, g, unknown or other
tcagtctacgtagccacgaccggtgctcgatttagatcgtctgtgttgggtttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctcggtaccgcacgaccccaggccacgccctccacgcacgctcatcanacgtacaaacnctcncctcgtccggggtccctgactcgccttctcgtcgctccacttccgtagggaaacaagcctcgccctcgaccnctcgaccggggcccagcgagacgatagaagtgtagtattactctacgttgtcgttaccttaggtcggtggggtcgtcggtattagggtttcgggttggtcgggacggtaacgggtacctaaacggtcgtaaccggttccgtacggttacgacgacccgtaaggtcctacccggtcccccgtcggtccctccgttcctttccccg

SEQ ID NO: 362862 - DNA, 660 bp, Homo sapiens
  misc_feature: GZ8MTXP02GSPJP.15.34.D01.1.454.CMB.2.raw
  modified_base (221)..(221): a, c, t, g, unknown or other
  modified_base (321)..(321): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgngccttgagtctggctcagtctctacttctaactacgccgcctggtaccggcacgaccccagccacgcctccacgcacgctcatctaacacgtacaaaacncctcgccttcgttcccggggtccctgtacgtcccgcctttctctcggtccctaccacttccgttacgggaaacaaaacggtcctacggccccttacaacccgtacgtcccggaaccgggggccccaaggggccaaacgtaaccggtagtacgaaacgtgtaggtacttacgtccgtaactcggtcgttaccgtttagtcgggtcgggtccgtggtacgtaggtttgggtcggtcgggacggaacgggtaccgaaacgttccgggaccttaccggtacgtaccgacgacccgaacgccgttacccggccccctcggtacctaccgttacccgtttccccg

SEQ ID NO: 362863 - DNA, 649 bp, Homo sapiens
  misc_feature: GZ8MTXP02F7H82.15.34.D01.1.454.CMB.2.raw
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccgaggagccattcgttctcagtcgtccccgtgggagggtacagtcaccgactctacgttgtcgtccgttggaggttctggcctctacgtcctcttacttactaactccgccgctcggtaccgcacgaccccaggccacgccctcaccgcaccgcttcactctacagtaaccaaaaccgcctccgtccgttccggttaccccggggtcctaggcttcccgtctttccgctcggactccgtacttccggtagaaacgtaacgcctcgcccctagccacgtccggacccgggcacggcgaacgacgtagtacgtaatggtatacgttacgtcgtacgttcggtcgtttaaccgttggtgggtcggggtcgtcggtacgttgggttcgggtcggttcggaacggtacgggaactaaccgtcgtaccgtcgtaacgccaccgccgaacgtcccgtaccgtcccccgtgtacctccgtcgtttcccccg

SEQ ID NO: 362864 - DNA, 604 bp, Homo sapiens
  misc_feature: GZ8MTXP02I5866.15.34.D01.1.454.CMB.2.raw
  modified_base (240)..(240): a, c, t, g, unknown or other
  modified_base (397)..(397): a, c, t, g, unknown or other
  modified_base (433)..(433): a, c, t, g, unknown or other
  modified_base (472)..(472): a, c, t, g, unknown or other
tcagtctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctntacttctaactacgccgcctggtacccgcacgaccccaggcccagccctccacgcacgctcatcacagtaccaaacactcgctccgttccggggtccctgactccgcttcgtctcggctaccattccgttagggaaacctaaagcctacgccccctnacccatccgaccggggcccgagcagacatggaatgngtattactacacgtcgtcgttcctttagttggtcggggngttcggtcttggttttggggttcggttccggggcggtaacgggaacctaaacgtcggaaccgttccgttacgggtaccacgacccgaacggtccctccggcccccgttaggtcccacttccgtttacccccg

SEQ ID NO: 362865 - DNA, 622 bp, Homo sapiens
  misc_feature: GZ8MTXP02HJ7FD.15.34.D01.1.454.CMB.2.raw
  modified_base (240)..(240): a, c, t, g, unknown or other
  modified_base (297)..(297): a, c, t, g, unknown or other
  modified_base (382)..(382): a, c, t, g, unknown or other
tcagtctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctcngtctctacttcctactacgccgcctcggtaccgcacgaccccaggccacgccctccnccgcacgctcatctacagtaacaacactcgctccgttacccgggtcctgctccgtcttctctggtctctactccgtacgggtaanaaacgtctacgccctcacctacgtccgacccggggcccaggccgaggaccgatagtaagtgttacgattactctaacgtcgttccgttaccttagtgggtcgggtcgtacggtagtgggtttcgggtcgggttacgggacgggtaacgggtacctaaccggtcgtacccggttaccgtaccggaccgtaccgtaccgaaccgtcgcccgtccccgtaccggtcctcccgtctttcccccg

SEQ ID NO: 362866 - DNA, 633 bp, Homo sapiens
  misc_feature: GZ8MTXP02I47KH.15.34.D01.1.454.CMB.2.raw
  modified_base (321)..(321): a, c, t, g, unknown or other
  modified_base (360)..(360): a, c, t, g, unknown or other
tcagtctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtcctggctcagtctctacttctaactacgccgctggtaccgcacgaccccaggccacgccctccaccgcacgctcatcacagtaacaaacnctcgcttccgttccggggtccctgtactccgtcttctcncggtcctaccacttccgttacggggaaacaaacgtcctaccgtccctacaacccagtcccggacccgggggcccaaggccgagtaaccgatagaattggtatacttaactcctacgtcgtacgtttaccctttaggtggtacggggctagttcgggacttggtttcgggtcgttcgggacgggacggtaaacctaccggtacgtacccggtacgtacggtccaacggaacccgacggtcctacccggccccgttacggtacctacgtttcccg

SEQ ID NO: 362867 - DNA, 602 bp, Homo sapiens
  misc_feature: GZ8MTXP01DJSHZ.51.57.F02.1.454.CMB.2.raw
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcgagggatccctgagcgatttcctctggctccaggtacagggaacaacgggtcacagttcggccatcagtggagtccgaggcagaggacgaggctgacttattattagtacaatcgaaacacgaccaacctagtttaggttaaccttagttcgttacgtttaccgggaacttcggaccgaaccgtaaagggttccctaaacccggttcccgttacggggttccaccggaaccccgtaaaacgggccccctaaaacccccgtacttcggtaaccgttaacccgtttcccg

SEQ ID NO: 362868 - DNA, 704 bp, Homo sapiens
  misc_feature: GZ8MTXP01D169S.51.57.F02.1.454.CMB.2.raw
  modified_base (240)..(240): a, c, t, g, unknown or other
  modified_base (283)..(283): a, c, t, g, unknown or other
tcagcgatcgtatacacgaccggtgctcgatttagctcgatatagttgggtttgggggtgggtccaggaggcagaactctgggtgtctcaccatggcctggatccctctacttctcccctcctcactctctgcacaggctctgaggcctcctatgagctgacacagccaccctggtgtcagtcgtccccaggacaggacggccaggatcacctgctcgtggagatgcattgaccaaacgntatgtcttattggtacagcagaagccggcacgccctgtgtggngatgtaataagacacgtgaaggacggccctagaggggactcccgtagacgcgtacttcctcgtacggctccgaggtaacgaacgggaacgaacgggtacaacgtagttacggacctaagtccgagggttacgggacgtacccgagggaccgaaaggggtaacgggaccggtaaagggccttaaggtaacgtttaattaaggtttcgtaacgtaacttaacctaaacgaacggaaccctaaaccgtagtttaccgggtttaactttagttcggttaccgttacgggtaaacgttcggaaccggaaccggtaaacggttcccgtaaacccggtttccgttacgggggttcccaaccgggtaacccgaaccgggtaaccccaaaccccgtaccgttacggtttaacccaaccggttttcccccg

SEQ ID NO: 362869 - DNA, 593 bp, Homo sapiens
  misc_feature: GZ8MTXP01ASBSO.51.57.F02.1.454.CMB.2.raw
  modified_base (573)..(573): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttatggtacagcagaagccggcaggccctgtgttggtgatgtaataaagacactgagacggccctcgagggactccctgagcgtattcctcgtggcctccgaggtaccaggggaacaaacgggtcaactagttcggacctagtcgaagtggagtccgagggcaaggaggacgaggctaggactattattgtaacgaatacaaacagaacctacctagttacggttacttaagtgttacctttacgggaaacttggaaccgaccgtaaacggttccgaacccggttccgttacggggttccacgaaccccaacggccccaaaaccccgngttacgtccaacgtttcccg

SEQ ID NO: 362870 - DNA, 535 bp, Homo sapiens
  misc_feature: GZ8MTXP01A5L06.51.57.F02.1.454.CMB.2.raw
  modified_base (427)..(427): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtacagcagaagccggcaggccctgtgttggtgatgtataaagacactgagaggcccctcgagggatccctgagcgtatttccctctggcctcccgaggtcgaagggaacaacgggtcacagttcggccatcagtggagtcgaggcaggagacgagctgacttatattgtacaatcaanagacacctattggtacttagtgtacttcggaactgcgacaacggttcgaaccgtccgttgggttccacgaaccccgaaggcccaaccccgacttcgtcaaccgttccg

SEQ ID NO: 362871 - DNA, 758 bp, Homo sapiens
  misc_feature: GZ8MTXP01BF2QO.51.57.F02.1.454.CMB.2.raw
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgtcttattggtaccagcagaacggccggcacggcccctgtgttggtagatagtaataaagacacgtagagacggccctacgaggggtactccccgtagacgcggtactttccgtcgtcggccttcccgagggttaccgaacgggggaaccaaacgggttccaaacgtacgtttcggacccgtaattccgaaggtttcgggaacggtcccgaagggaccgaagggaacgggtaccggaagggtccgtagtaaccgttaaagtttagttacggttaaccgtaaaacgtttacaaaaaccgtaacggaaaccctaaacccgtaaggttttaggttaaacccgttttattaccgggtttacgtttaaccggtaaacgttcggaacccgggttaaaccgtaaaccggggttacccgtacccgggttacccggtttcgggttaacccgaacccggaaccccggaaaccgggaaccccctaaaacccccgtcgttaccggtaacccgttaacctttcccccgg

SEQ ID NO: 362872 - DNA, 541 bp, Homo sapiens
  misc_feature: GZ8MTXP01ADZM7.51.57.F02.1.454.CMB.2.raw
  modified_base (527)..(527): a, c, t, g, unknown or other
  modified_base (534)..(534): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgtggtgatgtaataaagacactgagaggccctgagggactcccgtgagcgtattcctctggctccgaggtacagggaacaacgggtcacagttcggcatcagtggactccgaggcaggacggacgaggctagactattagttgacgaactacaaacacgaaccacctagttcggtacttagtgtacttacggactgacgacgacgttcgtaccgtcgttgggttcacgcccacggcccaacccgnttcgtcncgttccc

SEQ ID NO: 362873 - DNA, 527 bp, Homo sapiens
  misc_feature: GZ8MTXP01AYBUX.51.57.F02.1.454.CMB.2.raw
  modified_base (239)..(239): a, c, t, g, unknown or other
  modified_base (437)..(437): a, c, t, g, unknown or other
  modified_base (512)..(512): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattgtaccagcagaagccggccgaggcccctgtgtggtgatgtataaagacactgagacggccctcgagggactccctagagcgtacttcctcgtggcctccgaggtacagggtaacaacgggtcactattgggccatcagtgagtccgaggcagaggacgagggtctagactattattgtacaatacaanagacacctattggttacttatgttcttcgatcgcgacgaagcaccgtcgttcggttcacggcccaggcccaaccncttgtccaacgtccg

SEQ ID NO: 362874 - DNA, 643 bp, Homo sapiens
  misc_feature: GZ8MTXP01C579U.51.57.F02.1.454.CMB.2.raw
  modified_base (287)..(287): a, c, t, g, unknown or other
  modified_base (626)..(626): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatccacctgctcgtggagatgcattgaccaaaccgatatgtcttatgtaccagacagagccggcagccctgtgtggtnatgtaataaagacacgtgagacggccctacgaggtactcccgtagagtaccgtactttccgtccgtggtcctacccgacggtacaaaggaacgaaaccgaaaccgggttaccaactacgttcggaccctagtaccgagtagggacgtacccgaggggacaaagggaacgggaccgaggtccgtagtaaacgttatttaagttgggtaactaagtacaaccaagtacaccttagtttaggttaaccttagttacgtcttacgggaactcggaaccgaccgttaaacggtccacccggttcgttcgggttacaacccggtaccgaaccggacccaaccccncgttcgttccctaaccc

SEQ ID NO: 362875 - DNA, 611 bp, Homo sapiens
  misc_feature: GZ8MTXP01BD9LC.51.57.F02.1.454.CMB.2.raw
  modified_base (237)..(237): a, c, t, g, unknown or other
tcagcgatcgtatacacgaccggtgctcgatttagctcgatatagttgggtttgggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctggagatgcattgaccaaacgntatgtacttattggtaccagcagaacgccgggccacggcccctggtcgttggtgatgtaataaacgacactggaacgacggccctacgaggggtactcccgtagacgcgtactttcctcgtgctccgaggtcgaagggaaccaacgggtacacgtagttcgggaccaagtccgtaggtggacgtccgagggcaggaggacgaggctagacttaattagttgacaatacgaaacagacaacctagttaggtacttatcgttacttacggacttggaccgttaacgtacggttccgtaccggttccgttcggggttccaaccgaacccgaaaccggtccccaaaaccccgtcgttacggtcccttaactttccccg

SEQ ID NO: 362876 - DNA, 698 bp, Homo sapiens
  misc_feature: GZ8MTXP01EOY27.51.57.F02.1.454.CMB.2.raw
tcagcgatcgtatacacgaccggtgctcgatttagctcgatatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacaggacggccaggactccacctgctcgtggagatgctattacgaccaaaccgtatatgtacttagttcggtaaccagacgaaggaacggcccgggaccgacgggccccgttggttaggttggtgtagtaggtaaataaacgacgactcggaaggaccggtcccctacggaacgggtacttccccgtaggacgtccgtatttccccgtcgtcggcctaccggagggtaccgaagggaacacgggtacacgtagttcggacctagtcgaggtggacgtaccgaggcgaaggtacgggacgaggtctagtacttaatttattcgtacaaacttacgaaacacgaacctaacgtagtttacggtaactttacttcgggttacgtttaccggaacgttcggaaccgttaaaccggtaacggttcccgtaacccggtcggttcgggcccaccggaaccccgaaacggtccccaaacccctcggttcctaaccgttaaccgtttccccg

SEQ ID NO: 362877 - DNA, 634 bp, Homo sapiens
  misc_feature: GZ8MTXP01B5SHU.51.57.F02.1.454.CMB.2.raw
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctcgtggagatgcattcgaccaaaccgatatgtcttattggtaccagcagaacgccggccgacggccctgtgttggtgtatgtaataaagacacgtggagacgggcccctacgacggggacttccccgtggacgtcgtacttccctcgtggtcctccgaggtacgaacgggaacgtaacgggtcacgtagttcggactagtcgaggtggacgtaccgaggcgaaggtagggacgaaggtctaggtacttattattgtacgtaactacaaacacggaaccacgtaagttggttaacctttagtcgttacgttacggaactcggccgaaccgtaacggttccgaaccggttcgttcggggttccaaccggaaccccgtacgggaacccctaaacccgcttccgtccttaaccgtttccccg

SEQ ID NO: 362878 - DNA, 591 bp, Homo sapiens
  misc_feature: GZ8MTXP01EWAVD.51.57.F02.1.454.CMB.2.raw
  modified_base (314)..(317): a, c, t, g, unknown or other
  modified_base (319)..(319): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccttcctcactctctgcacaggctctgaggcctcctatgagctgacacagccaccctcggtgtcagtgtccccaggacagacggccaggatcacctgctctggagatgcattgaccaaaccgattaacgttacgtacgttacgttacgtacgtacgacgaacgaacggaccggaccgtaccggtaccgtacgttagnnnntntgtagtagtacgtacgtacgtaacgtacgtacgtacgtacgtacggtaccggtaccgtacgtaccgtaccgtacgtacgtacgtacgtacgtacgtacggtacgtacggtacggtaacggaaccggtaaccgtaaccgtaacgtaccgtacgtacgtacgtacgtacggtaacggtacggttacggtacggaacggaacggaacggaacggaacggttacggtaacgtaacgttaacgttaacgttacgttaacgtaacgttaacgtaaacg

SEQ ID NO: 362879 - DNA, 499 bp, Homo sapiens
  misc_feature: GZ8MTXP02F05OM.51.57.F02.1.454.CMB.2.raw
  modified_base (311)..(311): a, c, t, g, unknown or other
  modified_base (413)..(413): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagcactgagaggccctnagggatccctgagcgattcctctggctccaggtcagggcaacggtcacattgccatcagtgatccgaggcagaggacgaggctgactattattgcaatcaanagacaccattggtacttatgtactcggaactgacgacaacggtcaccgtcgtcggtcagcccgaaggcccaacccatcgtcactcg

SEQ ID NO: 362880 - DNA, 565 bp, Homo sapiens
  misc_feature: GZ8MTXP02IHKXC.51.57.F02.1.454.CMB.2.raw
  modified_base (239)..(239): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgtgtgatgtataaagcactgagaggccctagagggactccctgagcgtattcctctggctcgaggtcagggccaacgggtcacgtattcgggacctatcagtggagtccgaggacaggaggacgaggctagactattattgtacaaatcaacagaccaccatttggtacttagtgttacttacgggaacttacggccgaaccgaagggttcccaacccggttccgtacggggttccaacggccccgaaaacggccccaaaccccgtacgtccgtaccaaccttcccg

SEQ ID NO: 362881 - DNA, 495 bp, Homo sapiens
  misc_feature: GZ8MTXP02IXNBO.51.57.F02.1.454.CMB.2.raw
  modified_base (286)..(286): a, c, t, g, unknown or other
  modified_base (420)..(420): a, c, t, g, unknown or other
  modified_base (484)..(484): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggcaggcccctgtgttggngatgtataaagacactgagacggccctgagggatcccgtgagcgattctctggctccaggtcagggcaacggtcacattcgcatcagtgagtccgaggcagaggacgagctagactattatgtacaatcaaacngaccactattagtactatgtctaggactgacacgagtcacgtctggtcacgccgacgccacccntcgtcactccg

SEQ ID NO: 362882 - DNA, 588 bp, Homo sapiens
  misc_feature: GZ8MTXP02FSL2M.51.57.F02.1.454.CMB.2.raw
  modified_base (282)..(282): a, c, t, g, unknown or other
  modified_base (452)..(452): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttatggtaccagcagaagccggcaggccctgtgtgnatgataaagcatgagacggccctagagggactccctgagcgtattcctcgtggctaccgaggtcgaagggaccgaacgggtcaactaagttcgggaccagtcgaaggttcggaacgtcccgaagggcaaggacggacggaagctagaacttattattgtacaaatcaaanacgaacaacctattaggtacttagtcgttacttacggaacttcggaccgaaacgtaacggtccgtaaacccgttcgtacgggaccaacgaaccccgaaacggaccccaaaacccctagtccgtaccaactttcccg

SEQ ID NO: 362883 - DNA, 617 bp, Homo sapiens
  misc_feature: GZ8MTXP02GJRAY.51.57.F02.1.454.CMB.2.raw
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattcgaccaaaccgatatgtcttattggtaccagcagaacgccgggccacggcccctgtgttggtgagtagtaataaagacactgagacggccctgagggctccgtgacgcgtattcctcgtgctccgaggtaccgaggggaccaacggtcactagttcggacctatcgagtcggacgtccgaaggcgaagggacggaccggaggcgtagacgttaattagttcgtaacaataccaaaacgagaaccaaaccctagttacggttaacttatacggttacttacgggaactacgaccggaaactaacggtcctaaccggttcgtacggggtaccaacggaaccccgaaaccggaccccctaaacccgtacgtacgtacctaactttccccg

SEQ ID NO: 362884 - DNA, 635 bp, Homo sapiens
  misc_feature: GZ8MTXP02IVLSQ.51.57.F02.1.454.CMB.2.raw
  modified_base (240)..(240): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgcttagtgtacagcagagccggcagccctgtgtggtgatgtataaagcagtgaggacggcccctcgaagggtactccccgtaggacgcgtatttcccgtcgtggcctccgaggtccggaagggaccgaacgggtcacgtagttcgggcctaatccgagtggtacgcccgagggccgagaggacgaggctagacttattagttgttacaagttacaaacgagaaccaccgttagttacgttaacgttactggttacctttacggaaaccttcgggacccgtaaaccggtaacggttaccgaacccggtttccgtacggggttacccaaccggaaccccgtaaaacgggaccccctaaaaccccgtacgtaccgtaccctaacccgtttccccg

SEQ ID NO: 362885 - DNA, 612 bp, Homo sapiens
  misc_feature: GZ8MTXP02IR2FF.51.57.F02.1.454.CMB.2.raw
  modified_base (221)..(221): a, c, t, g, unknown or other
  modified_base (239)..(239): a, c, t, g, unknown or other
  modified_base (287)..(287): a, c, t, g, unknown or other
  modified_base (452)..(452): a, c, t, g, unknown or other
  modified_base (475)..(475): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgctctgganatgctattgaccaaacgntatgtacttattggtaccagcagaaggccggcacggccctgtgttggngatgtaataaagacactgagacggcctagaggactcctgagcgtattccgtctcggcctcgaggtacgaacgggaccgaacggtcaacgtacgttacggacctagtccagggtacgacgtacccgagggacaaggacggtacgagtcgtagactatttagtctanaaactacgaacagaaccaacgtnttacggttacttaagtcgttaaccgttacggaaacttcggaaccgtaaccggtaaacgtccgtaaccgttccgtacggttaccacgtaacccgaaaccggacccctaaaacccgccttacggtaccaccgtttcccg

SEQ ID NO: 362886 - DNA, 747 bp, Homo sapiens
  misc_feature: GZ8MTXP02FWOTF.51.57.F02.1.454.CMB.2.raw
  modified_base (245)..(245): a, c, t, g, unknown or other
  modified_base (249)..(249): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgctattcgacccaaaacgtntatntacttagtacgacagacgaggacggccggaccgccggtccgtggttggtggtagtatagtaaagtaaacgactacgtaggacggaccggtccctacggacggtaccttccgtagacgtacgttacttcccgtcgtcggtaccgtaccggtacgggtaccggaacgggaccgtaaccgtactaacgttacgttcggaacctacgtacggtaggtacgggtaccgtacgaagggacgaagggacggtacggagtacgtagtaacttagtttacgttacgaaactaaactaaccaaacgtaaccgtaaaccttaacgttacgtttacggttaaacgtttacgtaccggttacgttaacggtaaccgttacggaacccgtaaccggtaaccgggtaccccgttaaccggttaccggtaccgggtacccgaaaccggggtaaccccgaaacccggtaaccccctaaaccccgtaccgttaccgtaacccttacccgtttcccg

SEQ ID NO: 362887 - DNA, 580 bp, Homo sapiens
  misc_feature: GZ8MTXP02H3WZH.51.57.F02.1.454.CMB.2.raw
  modified_base (460)..(460): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacaggacggccaggatcacctgctctggagatgcattcgaccaaacgatatgcttattggtacagcagaacgccgggccaggcccctgtggttggtgatgtaataaagactacgtgagacggccctcgagggactcccgtagacgcgtattccgtcgtgtcctccgaggtacgacgggacctaaccgggtacacgtagttcggactagtcgaggtgacgtccgaggcaggaggacgaggctagtactattagttgtacaatcgaanagacacgtagtttagtacttagtgtacgttcggaactcgacgaacgtacgtaccgtaccgtcgtacgggtcaaccgaacccgaaaccggaccccaaaccccacgtacgtcctacgttccc

SEQ ID NO: 362888 - DNA, 641 bp, Homo sapiens
  misc_feature: GZ8MTXP02J0GRX.51.57.F02.1.454.CMB.2.raw
  modified_base (239)..(239): a, c, t, g, unknown or other
  modified_base (630)..(630): a, c, t, g, unknown or other
tcagcgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttagtggtaccagcagaacgccgggccaggcccctgtgtcggtgatgtataaagacactgagaggccctagagggactcccgtgacgcgtattcccacgtggcttaccgagggtccaaggggtccaaacggtcaactagttcgaccagttccagtagggtaagtcccgaaagggcccgaaggacggaccggaggtcctagtaccttaagtttacttgtacaaatcaaagacgaacaaccgtaatttacgggttaacctttaagtccgttacgtttacggtaaacgttcgaccggaaaccctaaagggtaccctaaacccggttccgtacgggttaccgaaccgggaacccccaacggggaccccaaaccccgaccgtcggttaccncctttaccccg

SEQ ID NO: 362889 - DNA, 634 bp, Homo sapiens
  misc_feature: GZ8MTXP01BCN0D.21.20.B09.1.454.CMB.2.raw
  modified_base (218)..(218): a, c, t, g, unknown or other
  modified_base (382)..(382): a, c, t, g, unknown or other
tcagtcgtcgctcgcacgaccggtgctcgatttagtgtagtgtgaggaaaggtctccgaagccttcggagaccctgtccctcacctgcactgtctctggtggctccatcatcaatggtcattatcactgggctggatccgccagccccagggagggctggagtgggttgcgagtatttttcatgatgggaccacctactataggtcgtcgctcgaacngtcgagtcaccatatccgtagacacgtccaggaaccagttctccctgaagctgaactctctgaccgcgcagacgcggtatatattatgtgacgagacatagtggtattggactactcgccccctagttacggtatcggacgtcgtgggggccaaaggggacccncgacgtccaccggtctcccgtcacgtccctaccaacccgaacgggccccaacgtcccgggttaccttaccccccgtggacccgcccctcgtccctaccgtacggacgtccaccccgtccgaacgacggacaaccgacggcccggccccgtcgggcctcggaccccgttgggtaccgaaacgggtaccttaaccgttccccggagttccggaaccgaccgtgggaacggccgggaccgtgggaaccgaacggg

SEQ ID NO: 362890 - DNA, 321 bp, Homo sapiens
  misc_feature: GZ8MTXP01DUUGL.21.20.B09.1.454.CMB.2.raw
  modified_base (318)..(321): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttgggttattactgcatgcaaagtgtgcaaattccgtacacttttggccaggggaccaagctggcgatcaaacgaactgtggctgcaccatctgtcttcatcttcccgcatctgacgagcgacgactgagcggctggcaaggcgcatagnnnn

SEQ ID NO: 362891 - DNA, 323 bp, Homo sapiens
  misc_feature: GZ8MTXP01ADQLI.21.20.B09.1.454.CMB.2.raw
  modified_base (320)..(323): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgcatctgacgagcgacgactgagcggctggcaaggcgcatagnnnn

SEQ ID NO: 362892 - DNA, 327 bp, Homo sapiens
  misc_feature: GZ8MTXP01DU9PM.21.20.B09.1.454.CMB.2.raw
  modified_base (322)..(327): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggagggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgcatctgacgagcgacgactgagcgggctggcaaggcgcatagnnnnnn

SEQ ID NO: 362893 - DNA, 326 bp, Homo sapiens
  misc_feature: GZ8MTXP01DDIC9.21.20.B09.1.454.CMB.2.raw
  modified_base (322)..(326): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgccatctgacgagcgacgactgagcgggctggcaaggcgcatagnnnnn

SEQ ID NO: 362894 - DNA, 326 bp, Homo sapiens
  misc_feature: GZ8MTXP01A3XQX.21.20.B09.1.454.CMB.2.raw
  modified_base (320)..(326): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgcatctgacgagcgacgactgagcggctggcaaggcgcatagnnnnnnn

SEQ ID NO: 362895 - DNA, 330 bp, Homo sapiens
  misc_feature: GZ8MTXP01C9VRL.21.20.B09.1.454.CMB.2.raw
  modified_base (323)..(330): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgcatctgacgagcgacgactgagcgggctggcaaggcgacagtagnnnnnnnn

SEQ ID NO: 362896 - DNA, 325 bp, Homo sapiens
  misc_feature: GZ8MTXP01BI9NT.21.20.B09.1.454.CMB.2.raw
  modified_base (320)..(325): a, c, t, g, unknown or other
tcagtcgtcgctcgcacgaccggtgctcgatttagtgtagtgtgaagggtgagctggaggaccgcaataggggtaggtcccctgtggaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgaactgtggctgcaccatctgtcttcatcttcccgccatctgacgagcgacgactgagcggctggcaaggcgcatagnnnnnn

SEQ ID NO: 362897 - DNA, 318 bp, Homo sapiens
  misc_feature: GZ8MTXP01CJN90.21.20.B09.1.454.CMB.2.raw
  modified_base (274)..(274): a, c, t, g, unknown or other
  modified_base (307)..(307): a, c, t, g, unknown or other
  modified_base (313)..(318): a, c, t, g, unknown or other
tcagtcgtcgctcgcacgaccggtgctcgatttagtgtagtgtgaagggtgagctggaggaccgcaatagggtaggtcccctgtggaaaagggtcagaggccaaaggatgggaggggtcagggacagatttcacactgagaatcagccggtggaggctgaggatgttgggttattactgcatgcaaagtgtgcaaattccgtacacttttggccagggaccaagctggcgatcaaacgaactgtggctgcaccatctgtctcatcctcccgcanctgacgagcgacgactgagcggctggcaaggcncatagnnnnnn

SEQ ID NO: 362898 - DNA, 321 bp, Homo sapiens
  misc_feature: GZ8MTXP02FZIWG.21.20.B09.1.454.CMB.2.raw
  modified_base (318)..(321): a, c, t, g, unknown or other
tcagtcgtcgctcgcacgaccggtgctcgatttagtgtagtgtgaagggtgagctggaggaccgcaatagggtaggtcccctgtggaaaagggtcagaggccaaaggatgggaggggtcagggacagatttcacactgagaatcagccgggtggaggctgaggatgttgggtttattactgcatgcaaagtgtgcaaattccgtacacttttggccagggaccaagctggcgatcaaacgaactgtggctgcaccatctgtcttcatcttcccgccatctgacgagcgacgactgagcgggctggcaaggcgcatagnnnn

SEQ ID NO: 362899 - DNA, 324 bp, Homo sapiens
  misc_feature: GZ8MTXP02G4PAP.21.20.B09.1.454.CMB.2.raw
  modified_base (320)..(324): a, c, t, g, unknown or other
tcagtcgtcgctcgcacgaccggtgctcgatttagtgtagtgtgaagggtgagctggaggaccgcaataggggtaggtcccctgtggaaaagggtcagaggccaaaggatgggaggggtcagggacagatttcacactgagaatcagccgggtggaggctgaggatgttgggtttattactgcatgcaaagtgtgcaaattccgtacacttttggccaggggaccaagctggcgatcaaacgaactgtggctgcaccatctgtcttcatcttcccgccatctgacgagcgacgactgagcgggctggcaaggcgcatagnnnnn

SEQ ID NO: 362900 - DNA, 323 bp, Homo sapiens
  misc_feature: GZ8MTXP02FO2HY.21.20.B09.1.454.CMB.2.raw
  modified_base (314)..(314): a, c, t, g, unknown or other
  modified_base (320)..(323): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggagggggtcagggacagatttcacactgagaatcagccgggtggaggctgaggatgttgggtttattactgcatgcaaagtgtgcaaattccgtacacttttggccaggggaccaagctggcgatcaaacgaactgtggctgcaccatctgtctcatcttcccgcatctgacgagcgacgactgagcgggctggcaaggcncatagnnnn

SEQ ID NO: 362901 - DNA, 324 bp, Homo sapiens
  misc_feature: GZ8MTXP02HT390.21.20.B09.1.454.CMB.2.raw
  modified_base (321)..(324): a, c, t, g, unknown or other
tcagtcgtcgctcgcacgaccggtgctcgatttagtgtagtgtgaagggtgagctggaggaccgcaatagggtaggtcccctgtggaaaagggtcagaggccaaaggatgggaggggtcagggacagatttcacactgagaatcagccgggtggaggctgaggatgttggggtttattactgcatgcaaagtgtgcaaattccgtacacttttggccagggaccaagctggcgatcaaacgaactgtggctgcaccatctgtcttcatccttcccgccatcctgacgagcgacgactgagcgggctggcaaggcgcatagnnnn

SEQ ID NO: 362902 - DNA, 326 bp, Homo sapiens
  misc_feature: GZ8MTXP02HAUC3.21.20.B09.1.454.CMB.2.raw
  modified_base (319)..(326): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggaggggtcagggacagatttcacactgagaatcagccgggtggaggctgaggatgttggggtttattactgcatgcaaagtgtgcaaattccgtacacttttggccaggggaccaagctggcgatcaaacgactgtggctgcaccatctgtcttcatcttcccgcatctgacgagcgacgactgagcggctggcaaggcgcatagnnnnnnnn

SEQ ID NO: 362903 - DNA, 322 bp, Homo sapiens
  misc_feature: GZ8MTXP02F5KRE.21.20.B09.1.454.CMB.2.raw
  modified_base (321)..(322): a, c, t, g, unknown or other
tcagtcgtcgctcgcacgaccggtgctcgatttagtgtagtgtgaagggtgagctggaggaccgcaataggggtaggtcccctgtggaaaaagggtcagaggccaaaggatgggagggggtcagggacagatttcacactgagaatcagccgggtggaggctgaggatgttgggtttatactgcatgcaaagtgtgcaaattccgtacacttttggccaggggaccaagctggcgatcaaaacgaactgtggctgcaccatctgtctcatcttcccgccatctgacgagcgacgactgagcggctgggcaaggcgcatagnn

SEQ ID NO: 362904 - DNA, 511 bp, Homo sapiens
  misc_feature: GZ8MTXP01B3944.10.63.F08.1.454.CMB.2.raw
  modified_base (193)..(193): a, c, t, g, unknown or other
  modified_base (203)..(203): a, c, t, g, unknown or other
  modified_base (233)..(233): a, c, t, g, unknown or other
  modified_base (253)..(253): a, c, t, g, unknown or other
  modified_base (368)..(368): a, c, t, g, unknown or other
  modified_base (462)..(462): a, c, t, g, unknown or other
  modified_base (491)..(491): a, c, t, g, unknown or other
tcagcatagtagtgcacgaccggtgctcgatttagcgatcgtataagggaggaactgctcagttaggacccagagggaaccatggaagcccagctcagcttctcttcctcctgctactctggctcccagaaactaccgcagaaattgtgttgacacagtctccagccaccctgtctttgtctccaggggaaanagccaccctntcctgcagggccagtcagagtgtttcccgntacttagcctggtaccaacngaagcctggccaggctcccaggctctcatgtatgatgcatccaacagggccactggcatcccagccaggttcagtggcagtgggtctgcacagacttcactctcaccatcaaacngcctagaacctgaagtatttgactacttttattctgttcaccagacgtcggctaactggcctccgacgttccggccaggggaccagggtcgagntcgaagacgaacttggtggcttggcaccntctgtcttcactcttccgcc

SEQ ID NO: 362905 - DNA, 623 bp, Homo sapiens
  misc_feature: GZ8MTXP01EAMTZ.10.63.F08.1.454.CMB.2.raw
  modified_base (197)..(197): a, c, t, g, unknown or other
  modified_base (387)..(387): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaanagccaccctctcctgcagggccagtcagagtcgtttcccgctacttagcctaggtaaccaacagaacgcctggccaggcctcccaggctcctcatgtatgatgcatccaacgacgggccacgtggccactccccagccaggttccaggtggcaggtgggtctgcgacaagacttcactctcacatcaaanacgacctaagaacctgaagttactttgacttacttttacttctacgttaccaacgtagtacgtcgggactaacgtcggaccccttccggaccggtttccgggacccggtaaagggggaccctaaaggggtcggaaacgtagtaacgaaggttaaccggtaaacgttgggtacgggtccttcggccttaccctaattccgttaagttcccttcgttactttcccgttaaccccgtcc

SEQ ID NO: 362906 - DNA, 639 bp, Homo sapiens
  misc_feature: GZ8MTXP01D3KD5.10.63.F08.1.454.CMB.2.raw
  modified_base (197)..(197): a, c, t, g, unknown or other
  modified_base (208)..(208): a, c, t, g, unknown or other
  modified_base (289)..(289): a, c, t, g, unknown or other
  modified_base (405)..(405): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaanagcccaccctntcctgcagggccagtcagagttcgttcccgctacttgcctaggtaaccaacagaacgcctggccaggctcccaggctcctnatgtatgatgcataccaacgacgggcccaacgtggccacgtccccagcccgtaggtttccaaggtggcgtaggttcggggtactggcgacaacgacttcactctacaccatcaaanacgacctagaacctagaactagttttacgacttacttttattctgtacacctagtacgttcgactaacgtcggtacccttaccggaccggttcggaccggtaacgggggaccgtaaaggggtaggacgtaacgtaacgtaagggaaccggtaaacgttcgggtcgggtaccttcggaccttaccgtaattccgttcgttacctttaccttaccgtttcccgtttccccgtaacc

SEQ ID NO: 362907 - DNA, 753 bp, Homo sapiens
  misc_feature: GZ8MTXP01B0TK2.10.63.F08.1.454.CMB.2.raw
  modified_base (194)..(194): a, c, t, g, unknown or other
  modified_base (718)..(718): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccacctgtctttgtctccgagggaancgccaccctctcctgcgagggccagtccagtagtcgtttcccgcttacgttacgcctaggtaaccaacagaacgccgtggccaggcctcccgaggcctcctctatgtatgatcgacaactacccgaaacgcgggcccaacgtcggacctaccgtccccgaggtaccgtaggttccgaggttcggccgtagggtcggggtactcggaccgtaactaacgtaccctttccaaccttcctacccaaacctataacccaaacgtaccggtacccttaaacgtaaaccgttaggtaaacgtttacttttacgtacccttttaaactttttactttcgtaccgttaaccctaaccggtaagtaaccggttaccgggaccttaaaccgggttccggtacccccggtttacccgggtaacccgggttaccccggggaaccggtaaaccggggggtaacctaaagggggtcggaacgtaacgtaacggaaacgttaaccggtaacgttcggtacggcttcggaccttaccgtntccgttgttccctacttccttcccgttcccgaacc

SEQ ID NO: 362908 - DNA, 531 bp, Homo sapiens
  misc_feature: GZ8MTXP02G6JG4.10.63.F08.1.454.CMB.2.raw
  modified_base (196)..(196): a, c, t, g, unknown or other
  modified_base (235)..(235): a, c, t, g, unknown or other
  modified_base (302)..(302): a, c, t, g, unknown or other
  modified_base (359)..(359): a, c, t, g, unknown or other
  modified_base (371)..(371): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgtttcccgntacttagcctggtaccaacagaagcctggccaggctcccaggctcctcatgtatgatgcatccaacngggccatggcatcccagccaggttcagtggcaggtgggtctgcgacagcttcactcncaccatcaaacngcctagaaccctgaagtatttgactactttatttctgtactaccagacgtcgctaacgtcggccctccgacgttccggccgagggggtaccaggtcggagacgtacgaggacgaacgtggtacggctcgccaccaatctcgtcttcacttccttcccgcc

SEQ ID NO: 362909 - DNA, 516 bp, Homo sapiens
  misc_feature: GZ8MTXP02FRW6Y.10.63.F08.1.454.CMB.2.raw
  modified_base (196)..(196): a, c, t, g, unknown or other
  modified_base (374)..(374): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtgtttcccgctacttagcctggtaccaacagaagcctggccaggctcccaggctcctcatgtatgatgcatccaaacagggccactggcatcccagccaggttcagtggcagtgggtctgcgacagacttcactctcaccatcaaacngacctagaaaccctgaaagtattttgactacttttatttctgtacaccagagtcgacaactcggcctcgacgttcggccgaggggaccagggtgagatacagacgactgtgctcgcaccaatctgtctcactccttacccgc

SEQ ID NO: 362910 - DNA, 534 bp, Homo sapiens
  misc_feature: GZ8MTXP02IZIJJ.10.63.F08.1.454.CMB.2.raw
  modified_base (197)..(197): a, c, t, g, unknown or other
  modified_base (235)..(235): a, c, t, g, unknown or other
  modified_base (305)..(305): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccacctgtctttgtctccgaggggaaagngccaccctctcctgcagggccagtcagagtgttcccgntacttagcctggtaccaacagaacgcctggccaggctcccaggctcctcatgtatgatgcatccaaacgngggccacgtggcactcccagccaggttcagtggcaggtgggtctggccgacagacttcactctacaccatacaaacagacctaagaacctagaaagtattttgactacttttatttctgtacaccagtagtccgctaacgtcgaccttaccgaccgttcggaccgaggggaccaggtaggagatacgagacgacgtggtcgctcgctacaatctcgtctcactctccgc

SEQ ID NO: 362911 - DNA, 586 bp, Homo sapiens
  misc_feature: GZ8MTXP02FYMN6.10.63.F08.1.454.CMB.2.raw
  modified_base (195)..(195): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaactaccgcagaaattgtgttgacacagtctccagccacctgtctttgtctccgaggggaaangccaccctctcctgcagggccagtcagagtgtttcccgctacttagcctggtaccaacagaagcctggccaggcctcccaggcctcctcatgtatgatgcatccaacgagggcccacgtggccactccccagcctaggttccaggtggcaggtgggtctggcgacagtacttcacttctaccaaccagtacaaacacgtaccctaagaaaccctagtaaagtattttgacttacttttatttctcgtacaaccgagtacgtcgactaacgtcggcccttaccggtaccggttccggacggaacggggtaccgaagggtagagactacgaagacgaacgtggtacggctcgaccacctaagttcctagttcctactacttcccttacccgtc

SEQ ID NO: 362912 - DNA, 600 bp, Homo sapiens
  misc_feature: GZ8MTXP02G5CYO.10.63.F08.1.454.CMB.2.raw
  modified_base (196)..(196): a, c, t, g, unknown or other
  modified_base (225)..(225): a, c, t, g, unknown or other
  modified_base (237)..(237): a, c, t, g, unknown or other
  modified_base (256)..(256): a, c, t, g, unknown or other
  modified_base (353)..(353): a, c, t, g, unknown or other
  modified_base (367)..(367): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgctccgaggggaaangcccaccctctcctgcagggccagtcagngtcgtttcccgntacttagcctggtaccaanagacgcctggccaggctcccaggctcctcatgtatgatgcatccaagaggccagtggcactcccgagccaggttcaggtggcaggtgggtctggcanagacttcaccttcnccaccataccaaacacgaccctaagaaaccctagtaaagtattttcgacttacttttactttactacgtaccaacgtagtacgtccgactaacgtcggtccctaccgtaccggttccggaccggtacggggacccgtaaggggtcggaagaacgtacgaaggaaccgaaacgttggtacgggcttacggaccacgtaatcgttacgtccttactccttaccgttacccgtacc

SEQ ID NO: 362913 - DNA, 582 bp, Homo sapiens
  misc_feature: GZ8MTXP02GJZIP.10.63.F08.1.454.CMB.2.raw
  modified_base (196)..(196): a, c, t, g, unknown or other
  modified_base (237)..(237): a, c, t, g, unknown or other
  modified_base (405)..(405): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtcgtttcccgntacttagcctggtaccaacagaacgcctggcccaggcctcccgaggcctcctcatgtatgatgcatccaaacgacggggcccacgtggccactccccgagccgtaggttcaggtggcgtaggtggggtctggaccgactacgtacttcactctaccaccatacaaacngaccctagaaacctgaagtatttgacttacttttattctagtaccacgagtacgtacgacaacgtcgacctccggacgttcggaccgagggggaaccagggtacggagagtacgacgacgtaacgtggtcgcgtacgacacctaagtccgtgttccttactacgttccttcccgacc

SEQ ID NO: 362914 - DNA, 545 bp, Homo sapiens
  misc_feature: GZ8MTXP02HJPBB.10.63.F08.1.454.CMB.2.raw
  modified_base (237)..(237): a, c, t, g, unknown or other
  modified_base (365)..(365): a, c, t, g, unknown or other
  modified_base (369)..(369): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaagagccaccctctcctgcagggccagtcagagtgtttcccgntacttagcctggtaccaacagaagccctggccaggctcccaggctcctcatgtatgatgcatccaacgagggccactggcactccccagccaggttcaggtggcacggtgggtctgcgacagacttcnctcnccacatcaaacacgacctaagaacctgaacgtatttgactactttatttctgtcacctagagtcgacaacgtcggacctccgaccgttcggacccgacggggtacaagggtaggagtactacgaagacgaaacgtgtacggctcgacactaatcgtcgtcttcactccttacccgc

SEQ ID NO: 362915 - DNA, 675 bp, Homo sapiens
  misc_feature: GZ8MTXP02IE50S.10.63.F08.1.454.CMB.2.raw
  modified_base (196)..(196): a, c, t, g, unknown or other
  modified_base (228)..(228): a, c, t, g, unknown or other
  modified_base (236)..(236): a, c, t, g, unknown or other
  modified_base (253)..(253): a, c, t, g, unknown or other
  modified_base (656)..(656): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctcagccaccctgtctttgtctccgaggggaaanagccaccctctcctgcagggccagtcagagtntttcccgntacttgcctggaccaanagaagcctggccaggcctcccgaggcctcctcatgtatgatgacatacccaacgacggggccaacgtcggaccaacttccccaggacccgtaacgggtttcaacgggtcggccgtaagggttcggggtccgtggaccggtaacgtacggtaacctttccgaacctttcctacccgtaaacccaacttaccaaaaaccctggacccttaaagaaaccccgttagtaaacgttagtttttacgacttaactttttattcgttgtacaccttaggacgttccgactaaacgttcggaccctcccgtacggttccggaccgaacgggggtacaaagggttcggaagaccgtcgaacggacgtaaactggtcgaccgtacaccgaactgtacctcggttaccttaacnccgttaccctttcccgacc

SEQ ID NO: 362916 - DNA, 575 bp, Homo sapiens
  misc_feature: GZ8MTXP02IYC5G.10.63.F08.1.454.CMB.2.raw
  modified_base (196)..(196): a, c, t, g, unknown or other
  modified_base (257)..(257): a, c, t, g, unknown or other
  modified_base (302)..(302): a, c, t, g, unknown or other
  modified_base (364)..(364): a, c, t, g, unknown or other
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctcgaggggaaancgccaccctctcctgcagggccagtcagagttcgtttcccgctacttagcctggtaccaanagaacgcctggccaggcctcccaggcctcctcatgtatgatgcanccaaagcggcccacgtggccacgtccccagcctaggttcaggtgctaggtggtctggcacgngtaccttcacttccacaccgtatacacagtaccctagaaacccgtagaacgttatttacattacttttattcctagtacctacagtacgtcgactaacgtcggccgtccgtacgtcggacgaagggtaccgaggtcggagtactacgacgaacgtacgtggacggtctacgtccaaccttgtcttcttacctactaccttcctacccgtcg

SEQ ID NO: 362917 - DNA, 518 bp, Homo sapiens
  misc_feature: GZ8MTXP01CSXTG.44.60.F05.1.454.CMB.2.raw
  modified_base (255)..(255): a, c, t, g, unknown or other
  modified_base (504)..(518): a, c, t, g, unknown or other
tcagacagtatatacacgaccggtgctcgatttagtacgtcatcagggaaagggactggagtggattggccatatctattatactgggtccaccaactacaatccgtccctcaagagtcgagtcaccatgtctttagacacgtccaagaaccaattctccctgaacctgagctctctgaccgttgcggacacggccgtctattactgtgcgaggaacatagcagcagcgtgggttggtcttattttgagttacgnggggccagtcgggcctggttacctctcctcacgccctccaaccgaacgggccctacgtcccggtcccttcccccgtcggcccctaccccctcctaccgaaacggtaccgccctaccgttccgggtcggggggaccaccgacggcccggcccggtgggcccctcggtccgtggtaccgaacggtaacccttacttcctatacttacgtgtacgtggacgggcgggtcgtaggacgaagggccgagaatgnnnnnnnnnnnnnnn

SEQ ID NO: 362918 - DNA, 452 bp, Homo sapiens
  misc_feature: GZ8MTXP02GF0L0.44.60.F05.1.454.CMB.2.raw
  modified_base (280)..(280): a, c, t, g, unknown or other
  modified_base (284)..(284): a, c, t, g, unknown or other
  modified_base (316)..(316): a, c, t, g, unknown or other
  modified_base (398)..(398): a, c, t, g, unknown or other
  modified_base (401)..(401): a, c, t, g, unknown or other
  modified_base (431)..(452): a, c, t, g, unknown or other
tcagacagtatatacacgaccggtgctcgatttagtacgtcatcagggaaagggactggagtggattggccatatctattatactgggtccaccaactacaatccgtccctcaagagtcgagtcaccatgtctttagacacgtccaagaaccaattctccctgaacctgagctctctgaccgttgcggacacggccgtctattactgtgcgaggaacatagcagcagcgtgggttggtcttattttgattacgtgggcagtcggccctggttcctctccncacncctccacgacggcccagtccgtccttccccgngcctacccctcctacagacgcacctcggtggggcacgcgccggccgtggcctcgcgtgacgacgacttctcctatacttacngtnggagcgggtcgtcggacgaagcgacagtgnnnnnnnnnnnnnnnnnnnnnn

SEQ ID NO: 362919 - DNA, 569 bp, Homo sapiens
  misc_feature: GZ8MTXP01AJBZT.8.73.G07.1.454.CMB.2.raw
  modified_base (557)..(557): a, c, t, g, unknown or other
  modified_base (559)..(569): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatccggccctgaggggtctctgaccgattctctgcctcaagtctggctacttctcgccctcctggtcatatctggtctcgaggtgaggatgaggctgtatttatactgcctactcctatcgacaacaacgccttggacgtttagttttgggcgtttgggttcggggcgggtaccgggaacctaaaggttcgacccgtccgtacgtccacggcccgaaggccgtccgcccccttcggtacctacccgttccgttccgttcccccggccccttcccgtaccgaccgacgccgagtccgtggacggtccgggcgtcgggcgaacgggccgcgagtagngnnnnnnnnnnn

SEQ ID NO: 362920 - DNA, 475 bp, Homo sapiens
  misc_feature: GZ8MTXP01D94UB.8.73.G07.1.454.CMB.2.raw
  modified_base (470)..(475): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacaagcctgagtatttggctgttcggcgcgggacaagttgacgtctacgtcagcccaaggctcgcccctggtcactctcgttcccaccctcctcgacacgcgagctgagcgggctggcaggcgcatagnnnnnn

SEQ ID NO: 362921 - DNA, 487 bp, Homo sapiens
  misc_feature: GZ8MTXP01D2WNZ.8.73.G07.1.454.CMB.2.raw
  modified_base (307)..(307): a, c, t, g, unknown or other
  modified_base (328)..(328): a, c, t, g, unknown or other
  modified_base (463)..(463): a, c, t, g, unknown or other
  modified_base (479)..(487): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgataacaacaatcggccctgaggggtctctgaccgattctctgcctccaagtctggcacttctgccctccctggtcatatctggtctccagggtnaggatgaggctgattattacngccactcctatgacaacagcctgagtattgggctggttcgggcggcgggacaagttgaccgtctacgtcagcccaagctcgccccctcggtcacttcgtcgttcccaccctcctcgacacgcgagctgagcgggntggcaaggcgcatagnnnnnnnnn

SEQ ID NO: 362922 - DNA, 548 bp, Homo sapiens
  misc_feature: GZ8MTXP01BFW9S.8.73.G07.1.454.CMB.2.raw
  modified_base (232)..(232): a, c, t, g, unknown or other
  modified_base (310)..(310): a, c, t, g, unknown or other
  modified_base (510)..(510): a, c, t, g, unknown or other
  modified_base (536)..(536): a, c, t, g, unknown or other
  modified_base (538)..(548): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctnaggggtctctgaccgattctctgccctccaagtctggcacttctgccctccctggtcatatctggtctcgaggtgagntgagctgatttatactcgcctacctcctatcgaacaacgagtcctgagttagtttgggcttagggttcgggcgggtacgggacctaaggttcggaccgtccgtaccgtcacgcccgaaggcctccgcccccgtcggtacctacctcgtcgtttccccgcccttccctacgccaccgcgtacgcgtcggacggccgggtcncgggcgaaagggccgcgaaacgtggngnnnnnnnnnnn

SEQ ID NO: 362923 - DNA, 542 bp, Homo sapiens
  misc_feature: GZ8MTXP01CR71L.8.73.G07.1.454.CMB.2.raw
  modified_base (508)..(508): a, c, t, g, unknown or other
  modified_base (522)..(522): a, c, t, g, unknown or other
  modified_base (528)..(528): a, c, t, g, unknown or other
  modified_base (530)..(530): a, c, t, g, unknown or other
  modified_base (532)..(542): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcgaggggtctctgaccgattctctgcctccaagtctggctacttctcgcctcctgtcatatctgtctcgaggggtgaggatggaggctgtattattactcgcctacccttcctatgaacaacaacgcctgtagttatttgggcgtggttcgggcgggacgggactaagttcgaccgtctacgtccacgcccgaaggcctccgcccccgtcgggtcctaccttcgttccgttccccgtcccctccgtcgaccacgcgacgcgtggacggcgggtccgngggacaacggggcncgaagngngnnnnnnnnnnn

SEQ ID NO: 362924 - DNA, 487 bp, Homo sapiens
  misc_feature: GZ8MTXP01BYYRY.8.73.G07.1.454.CMB.2.raw
  modified_base (478)..(487): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgccctccctggtcatatctggtctcaggtgaggatgaggctgattatactgccactcctatgacaacaagcctgatatttgggctggttcgggcggcgggacctaagttgaccgtctacgtcaacgcccaagctcgccccctggtcaccttctcgttccccaccctcctcgacacgcgagctgagcggcgtgcgaggcgcgannnnnnnnnn

SEQ ID NO: 362925 - DNA, 509 bp, Homo sapiens
  misc_feature: GZ8MTXP01BOAUI.8.73.G07.1.454.CMB.2.raw
  modified_base (473)..(473): a, c, t, g, unknown or other
  modified_base (495)..(495): a, c, t, g, unknown or other
  modified_base (497)..(505): a, c, t, g, unknown or other
  modified_base (507)..(507): a, c, t, g, unknown or other
  modified_base (509)..(509): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagtcatcggggcaggttatgatgttcattggtaccgccaggttccaggcacagcccccgagactcctcattaatgataacaacaatcggccctcagggtctctgaccgattctctgcccttccaagtctggcacttctgcctccctggtccatatctggtctccgagggtgaggatgaggtctgatttatactgccactcctatgacacaagctgatagttggctggttcggcgtcgggacctaagttcgaccgtctacgtcagccccaaggctcgacccctggtcacctcgtcgttccccaccctcctacgaccacgcgagctggacgcgggntggcgaaagggcgcgagtaggngnnnnnnnnngngn

SEQ ID NO: 362926 - DNA, 514 bp, Homo sapiens
  misc_feature: GZ8MTXP01CIH7S.8.73.G07.1.454.CMB.2.raw
  modified_base (506)..(514): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctcaagtctggcacttctgcctccctggtcattatctggtctccgaggggtgaggatgagggctgtatttatactgccactcctatgacaacaagcctgagtattggctggtcggcggcgggacaagttcgaccgtcctacgtcacgtcccgaggcctcgccccctcggtccaccgttccgttcccgtcccctaccccttccgaccgaccgcgacgacgtcgtaggcggcggtcgcggacgacgcagagnnnnnnnnn

SEQ ID NO: 362927 - DNA, 554 bp, Homo sapiens
  misc_feature: GZ8MTXP01ENBLJ.8.73.G07.1.454.CMB.2.raw
  modified_base (520)..(520): a, c, t, g, unknown or other
  modified_base (540)..(540): a, c, t, g, unknown or other
  modified_base (542)..(542): a, c, t, g, unknown or other
  modified_base (544)..(554): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataaacaacaatcggccctcgagggtctctgaccgtattctctgcctcaagtctggcacttctcgccctcccgtggtcatatcgtgtctcgaggggtgaggatggaggtctgtatttattactcgcctaccttcctatcgaacaacgaacgtcctgagtttagttggcgttgggttcggggcgggaccgggtacctagttcgacccgtcctacgtacacgcccgaacgcctccgccccctggtcctaccttccggttccgttccccgtccctccgtacgaccacggcgacgtcgtagcggcgggngcgggcaacggggccagagngngnnnnnnnnnnn

SEQ ID NO: 362928 - DNA, 510 bp, Homo sapiens
  misc_feature: GZ8MTXP01EE2MH.8.73.G07.1.454.CMB.2.raw
  modified_base (231)..(231): a, c, t, g, unknown or other
  modified_base (326)..(326): a, c, t, g, unknown or other
  modified_base (406)..(406): a, c, t, g, unknown or other
  modified_base (497)..(498): a, c, t, g, unknown or other
  modified_base (500)..(510): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctnaggggtctctgaccgattctctgcctccaagtctggcacttctgcctccctggtcatatctggtctccaggggtgaggatgagctgtattatacngccactcctatgacaacagcctgagtatttggcttgttcgggcggcgggactaagttgaccgtctacgtcacgccaggcncgcccctggtctctccgttcgttccccgcccttcctccgacacccgtagccgtggacggtcgggcgtgggcaacgggccggcttaagtggnngnnnnnnnnnnn

SEQ ID NO: 362929 - DNA, 551 bp, Homo sapiens
  misc_feature: GZ8MTXP01DXS45.8.73.G07.1.454.CMB.2.raw
  modified_base (315)..(315): a, c, t, g, unknown or other
  modified_base (331)..(331): a, c, t, g, unknown or other
  modified_base (539)..(540): a, c, t, g, unknown or other
  modified_base (542)..(551): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataaacaacaatccggccctgaggggtctctgaccgtattctctgcctccaagtctggcacttctgcctccctggtcatatctggtctcgagggtgaggntgaggctgattatacngcctactcctatgaacaacagcctgagttagtttgggccgttcgggtcgggacgggaccgaacgttacgttccgtacctacgtacgtacgaccgaccgacgtccgccccgtcccgtcgtacctccttccggttacccctccccctaccgttccgacgacccgcgacgtaccgcgtacggcgggccgtcggcgaacggacggcacaagnngnnnnnnnnnn

SEQ ID NO: 362930 - DNA, 511 bp, Homo sapiens
  misc_feature: GZ8MTXP01CATJA.8.73.G07.1.454.CMB.2.raw
  modified_base (311)..(311): a, c, t, g, unknown or other
  modified_base (328)..(328): a, c, t, g, unknown or other
  modified_base (462)..(462): a, c, t, g, unknown or other
  modified_base (499)..(499): a, c, t, g, unknown or other
  modified_base (501)..(511): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgataacaacaatcggccctgaggggtctctgaccgattctctgcctcaagtctggcacttctcgccctccctggtcatatctggtctcgagggtgagntgaggctgatttatacngccacctcctatgaacaacagcctgattagttgctggtcggcggcgggacagttcgaccgtctacgtcgacgcccgaaggccgtccgcccccgtcggtctaccttcgtcccgttccccacccctccgtcgaccncgcgacgcgtaggcgcgggctcggcaggccgagagtngnnnnnnnnnnn

SEQ ID NO: 362931 - DNA, 612 bp, Homo sapiens
  misc_feature: GZ8MTXP01CQ6X9.8.73.G07.1.454.CMB.2.raw
  modified_base (303)..(303): a, c, t, g, unknown or other
  modified_base (601)..(601): a, c, t, g, unknown or other
  modified_base (603)..(612): a, c, t, g, unknown or other
tcagctcgcgtgtccacgaccggtgctcgatttagctctacgctcagggtcctgggcccagtatgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataaacaacaatccggccctcgaggggtctctcgaccgtattctctcgccctcaagtctggcctacttctcgccctccctggtctatntctggtctccggagggtagagagtggagtctagtattacttactcgacctacccttacctagtagaaccaacgacgtacctgtaagtttaggttcggtcgtacgggtcggggcggggaccggtaaccgttaaggtccgtacccgtcgtaccgtacgaccggacccgtaacggtccctcccggtcccccgtcggtacctacccggtttccttccccggttaccccctacccttcccgacgacccgccgacggtacgcgtgggacgggtccggtcggcggacggacgggccagtaagcgngnnnnnnnnnn

SEQ ID NO: 362932 - DNA, 721 bp, Homo sapiens
  misc_feature: GZ8MTXP01DDQES.8.73.G07.1.454.CMB.2.raw
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcaattaatgaataaacaacaatccggccctcgaggggtctctgaccgtattctctcgccctacaagtctggctacttctcgtcctcctgtcatatctggtctcgagggtgaggatggagtctagtatttactctcgacctacctcctatcgaaacaacgaaacgtccgttggtaagttacgtttcgggcgtttcggggttccggggcgggtaccgggggtaaaccttaacgggttaccgtaaccccggttaccgttaaccggtaccgtaaaccgggaccccgtaaaggggtccccttacccggtcccccccgttacggttaccccgttaaccctttcccggtttccccgggtttaacccccctaacccccttttaccccggtaacccggtaaaccccgtaacccgggtccggtaaaccggggccgttaccgggggtaaccggggtcccgggggtaccgtaacgggggtaaccccgttaaaggggggtccccttaacgggtaaaacggtaacggtta

SEQ ID NO: 362933 - DNA, 536 bp, Homo sapiens
  misc_feature: GZ8MTXP01D27A1.8.73.G07.1.454.CMB.2.raw
  modified_base (310)..(310): a, c, t, g, unknown or other
  modified_base (317)..(317): a, c, t, g, unknown or other
  modified_base (328)..(328): a, c, t, g, unknown or other
  modified_base (348)..(348): a, c, t, g, unknown or other
  modified_base (518)..(518): a, c, t, g, unknown or other
  modified_base (522)..(522): a, c, t, g, unknown or other
  modified_base (524)..(524): a, c, t, g, unknown or other
  modified_base (526)..(536): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgccaggttccaggcacagcccccagactcctcattaatgataacaacaatcggccctgagggtctctgaccgtattctctgcctcaagtctggcacttctcgcctcctggtcattatctggtctcgagggtgaggntggagtntgatttatacngccactcctatgaacagacncctgagtttatttggcgttgggttcgggcgggtacgggacgtagttcgtaccgtctacgtcgtacgaccgaagccgtcgcccccgtcggtcctccgttccggttcccgtttccccgtccccttccgccgaaccgaccgcgacgccgtgcggcgggcgcggacgacgggcngagngngnnnnnnnnnnn

SEQ ID NO: 362934 - DNA, 541 bp, Homo sapiens
  misc_feature: GZ8MTXP01AMQ9J.8.73.G07.1.454.CMB.2.raw
  modified_base (277)..(277): a, c, t, g, unknown or other
  modified_base (291)..(291): a, c, t, g, unknown or other
  modified_base (308)..(308): a, c, t, g, unknown or other
  modified_base (324)..(324): a, c, t, g, unknown or other
  modified_base (529)..(529): a, c, t, g, unknown or other
  modified_base (531)..(541): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatccggccctcgaggggtctctgaccgattctctgccctcaagtctggcacttcngccctcctgtcatntctgtctcgaggtgagntgagctgtattatacngcctactcctatgaaccaacgacgtcctgtagtttagttgggcttgggtcgggcgggacgggtacctaggttccgaccgtcctacgtcaccgccaaggcctccgacccccgtggtacctaccttccgttcccgttcccccaccctcccgtacgaccgcgcgtacgcgtggacggccgggtcgtcggcgaacggcgttacgagtgngnnnnnnnnnnn

SEQ ID NO: 362935 - DNA, 537 bp, Homo sapiens
  misc_feature: GZ8MTXP01BZ9NP.8.73.G07.1.454.CMB.2.raw
  modified_base (265)..(265): a, c, t, g, unknown or other
  modified_base (313)..(313): a, c, t, g, unknown or other
  modified_base (348)..(348): a, c, t, g, unknown or other
  modified_base (525)..(525): a, c, t, g, unknown or other
  modified_base (527)..(537): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacagccccagactcctcattaatgaataacaacaatcggccctagaggggtctctgaccgtattctctgcctcaagtcnggcacttctcgccctccctggtctatatcgtggtctcgagggtgaggntgaggtctgtattacttactgccctactccgtaanacgaacacagtctgtagttgttggcgtggtcgggcgacggtactagtcgaccgtcgtacgacgacgaccgacgtcctccgtccccgtcgtacctccttccgttcccgttcccctacccgtccgtaccgaccgccgacgacgcgtacggcggcggcgtcggacgacggcgagtagtgngnnnnnnnnnnn

SEQ ID NO: 362936 - DNA, 563 bp, Homo sapiens
  misc_feature: GZ8MTXP01C4ZO0.8.73.G07.1.454.CMB.2.raw
  modified_base (257)..(257): a, c, t, g, unknown or other
  modified_base (269)..(269): a, c, t, g, unknown or other
  modified_base (333)..(333): a, c, t, g, unknown or other
  modified_base (545)..(545): a, c, t, g, unknown or other
  modified_base (554)..(563): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccccagacctcctctaattaatgaataaacaacaatccggccctgagggtctctgactattcnctgcctcagtcnggctacttctcgccttcctgtcatatcgtgtctcgagggtgagatgaggtctgtattacttacngaccctactacctatcgaaacaacgtaacgtcctggtaagtttagtttcgggtcgttcgggtttacggggacggggaccgggtaaccgtacgttcggacccgtcctacgtccgacgcccgaagcctcccgcccccgtcggtcctaccgttccgttcccgttccccgccctccctccgaccgacgcgacgtccgtggacggcggcgtggacgnggcgcaagnnnnnnnnnn

SEQ ID NO: 362937 - DNA, 666 bp, Homo sapiens
  misc_feature: GZ8MTXP01E3R7I.8.73.G07.1.454.CMB.2.raw
  modified_base (212)..(212): a, c, t, g, unknown or other
  modified_base (256)..(256): a, c, t, g, unknown or other
  modified_base (651)..(651): a, c, t, g, unknown or other
  modified_base (653)..(654): a, c, t, g, unknown or other
  modified_base (656)..(662): a, c, t, g, unknown or other
  modified_base (664)..(664): a, c, t, g, unknown or other
  modified_base (666)..(666): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaangaataacaacaatccggccctcgaggggtctctgaccgtattcnctgcctcaagtctggcacttctgccctcctggtcatatctcggtctccgagggtcaggatgaggtctgtattatactgcctacctcctatacgaacaacgaagtcctggtacgttagtttcgggcttgggttcggggacgggtccggggtaaccgtaaaggttcggaccccggttaccgtaaccgttcgaaaccggtccccgaaacgggtcccgtcccggtcccccccgttcgggttaccctaacccgttcccggtttacccggtttaccccccaaccccgttcccccgttacccggaacccgtaccccggaccggtaaccgggtccgttacgggaaccggggtcccggggccggttcgggaaccgaaacgggggccgacccgaagttaaccggngnngnnnnnnngngn

SEQ ID NO: 362938 - DNA, 547 bp, Homo sapiens
  misc_feature: GZ8MTXP01AJP08.8.73.G07.1.454.CMB.2.raw
  modified_base (538)..(547): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgaataacaacaatcggccctcaggggtctctgaccgattctctgcctcaagtctggcacttctgcctcctggtcatatctggtctccgagggtgaggatggagctgattattactcgccacctctatcgaactacaaacgcctgagtttagtttgggtctggttcgggcgggacgggacctaagttcggacccgttccgtacgtcgacgcccgtaaggcctcgtccccccgtcgggtcctacctccgttccgttcccccgcccttccctccgaccgaccgcggacgccgtgacggcgggcgtggggcaacgggcgcgtaagtcggnnnnnnnnnn

SEQ ID NO: 362939 - DNA, 521 bp, Homo sapiens
  misc_feature: GZ8MTXP01BGZXN.8.73.G07.1.454.CMB.2.raw
  modified_base (509)..(510): a, c, t, g, unknown or other
  modified_base (512)..(521): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccccagacctcctcattaatgataacaacaatcggccctgaggggtctctgaccgattctctgcctcaagtctggcacttctcgcctccctggtcatatctggtctcgagggtgaggatggagctgtatttattactcgcctacctcctatcgaacaacaacgcctgagttagttggctggttcgggcggcgggactagtcgaccgtctacgtcacgccgacgcctcgccccctcggtccaccttcgttccgttccccgcccctccgtccgaccgaccgcgacgctggacgccgggcgtcggcgaggcgcgaagnngnnnnnnnnnn

SEQ ID NO: 362940 - DNA, 483 bp, Homo sapiens
  misc_feature: GZ8MTXP02F943L.8.73.G07.1.454.CMB.2.raw
  modified_base (325)..(325): a, c, t, g, unknown or other
  modified_base (478)..(483): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatacngccactcctatgacaacagcctgatatttggctgttcggcggcgggaccaagttgaccgtcctacgtcagcccaaggctcgccccctcggtcacctctcgttccccgccctcctcgaccacgcgagctgagcggggctgggcaggcgcatcgnnnnnn

SEQ ID NO: 362941 - DNA, 487 bp, Homo sapiens
  misc_feature: GZ8MTXP02I5SWD.8.73.G07.1.454.CMB.2.raw
  modified_base (306)..(306): a, c, t, g, unknown or other
  modified_base (381)..(381): a, c, t, g, unknown or other
  modified_base (422)..(422): a, c, t, g, unknown or other
  modified_base (477)..(487): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtccatatctggtctccagggtnaggatgaggctgattattactgccactcctatgacaacagcctgatatttggctgttcggcgcgggaccaagttnaccgtctacgtcagcccaaggctcgccccctggtcacttcncgttcccaccctctcgaccacgcgagcctgagcgggctggcaaggcgcactagcnnnnnnnnnnn

SEQ ID NO: 362942 - DNA, 485 bp, Homo sapiens
  misc_feature: GZ8MTXP02JYZ3P.8.73.G07.1.454.CMB.2.raw
  modified_base (476)..(485): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattatactgccactcctatgacaacagcctgatatttggctgttcggcggcgggaccaagttgaccgtcctacgtcagcccaaggctcgccccctcggtccactctcgttcccgccctcctcgacacgcgagctgacgcgggctcggcaggcgcatagnnnnnnnnnn

SEQ ID NO: 362943 - DNA, 488 bp, Homo sapiens
  misc_feature: GZ8MTXP02HO1D3.8.73.G07.1.454.CMB.2.raw
  modified_base (325)..(325): a, c, t, g, unknown or other
  modified_base (480)..(488): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctcaagtctggcacttctgcctccctggtcatatctggtctccagggtgaggatgaggctgattattacngccactcctatgacaacagctgagtatttgcttggttcggcgcgggacagtgaccgtcctacgtcacgcccaaggctcgccccctcggtcaccttctcgttcccgccctcctcgaccacgcgagcgtgacgcgggctcggcgaaggcgcatacgnnnnnnnnn

SEQ ID NO: 362944 - DNA, 483 bp, Homo sapiens
  misc_feature: GZ8MTXP02FOUS8.8.73.G07.1.454.CMB.2.raw
  modified_base (292)..(292): a, c, t, g, unknown or other
  modified_base (309)..(309): a, c, t, g, unknown or other
  modified_base (472)..(483): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatcnggtctccgaggtgaggntgagctgatttatactgccactcctatgacaacagcctgagtatttggctgttcggcggcggactagtcgaccgtctacgtcagcccaaggctgccccctgtcactctcgtcccaccctctcgaccacgcgagctgagcggctggacgaaggcgacagtacgnnnnnnnnnnnn

SEQ ID NO: 362945 - DNA, 498 bp, Homo sapiens
  misc_feature: GZ8MTXP02HULIK.8.73.G07.1.454.CMB.2.raw
  modified_base (326)..(326): a, c, t, g, unknown or other
  modified_base (489)..(498): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattacngccacctctatgacaacacgcctgagttagtttggcgttgttcgggcggcgggacctaagttcgaccgtcctacgtcacgcccaaggctcgccccctcggtcacgtcctcgttccccaccctcctcgacacgcgagctgacgcgggctggcaggcgcagtagnnnnnnnnnn

SEQ ID NO: 362946 - DNA, 478 bp, Homo sapiens
  misc_feature: GZ8MTXP02JLR97.8.73.G07.1.454.CMB.2.raw
  modified_base (326)..(326): a, c, t, g, unknown or other
  modified_base (344)..(344): a, c, t, g, unknown or other
  modified_base (392)..(392): a, c, t, g, unknown or other
  modified_base (470)..(478): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctccctggtcatatctgtctccgagggtgaggatgaggctgattatacngccactcctatgacaacngcctgagttattggctgttcggcggcggacagttcgaccgtctatcanccaagctcgcccctgcactctcgttccccaccctcctacgacacgcgacgctggacgcgggctggcaaggcgacatgnnnnnnnnn

SEQ ID NO: 362947 - DNA, 487 bp, Homo sapiens
  misc_feature: GZ8MTXP02G0ZND.8.73.G07.1.454.CMB.2.raw
  modified_base (482)..(487): a, c, t, g, unknown or other
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgcctccctggtcatatctggtctccagggtgaggatgaggctgattattactgccacctcctatgacaacagcctgagtatttgctgttcggcggcgggaccagttcgaccgtctacgtcagcccaaggctcgccccctggtccacgtctcgttcccaccctcctcaccacgcgacgctgacgcgggcgtcggcaaggcgcaatgnnnnnn

SEQ ID NO: 362948 - DNA, 479 bp, Homo sapiens
  misc_feature: GZ8MTXP02JSPRL.8.73.G07.1.454.CMB.2.raw
  modified_base (467)..(467): a, c, t, g, unknown or other
  modified_base (470)..(479): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgccctccctggtcatatctggtctccagggtgaggatgaggctgattatactgccacctcctatgacaacagctgatatttgctgttcggcgcgggacagttgaccgtctacgtcagcccaagctcgccccctcggtcactctcgttcccaccctcctcgaccacgcgagctgagcggctcggcaaggcgcanagnnnnnnnnnn

SEQ ID NO: 362949 - DNA, 557 bp, Homo sapiens
  misc_feature: GZ8MTXP02IHBLO.8.73.G07.1.454.CMB.2.raw
  modified_base (548)..(557): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcgagggtctctgaccgattctctgcctcagtctggcacttctgccctccctggtcatatctggtctccgagggtgaggatgaggctgattatactgcctacctcctatgacaacagcctggtagttagtttgggtcttgggttcgggcgggtaccgggacctaaaggttcgacccgtccgttacgtcacgccccaaggcctccgccccctcggtcctaccgttccttccggttcccccgcccccttcccgtcccgtaccgaaccgcggacgtccgtggacggccggggctcggggacgaaacggccgacaacgtcgcgnnnnnnnnnn

SEQ ID NO: 362950 - DNA, 500 bp, Homo sapiens
  misc_feature: GZ8MTXP02HSC3B.8.73.G07.1.454.CMB.2.raw
  modified_base (311)..(311): a, c, t, g, unknown or other
  modified_base (346)..(346): a, c, t, g, unknown or other
  modified_base (472)..(472): a, c, t, g, unknown or other
  modified_base (483)..(483): a, c, t, g, unknown or other
  modified_base (490)..(500): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctggcacttctgccctccctggtcatatctggtctccgaggtgaggntgaggctgattattactgccactcctatgaacaanacgctgtagttatttggcttggtcggcggcgggaccaaagttcgaccgtcctacgtcacgtcccaagcctcgccccctggtcactctcgttcccgccctctccgacacgcgacgctgacgcggtcncggacaaggcncaatcgnnnnnnnnnnn

SEQ ID NO: 362951 - DNA, 480 bp, Homo sapiens
  misc_feature: GZ8MTXP02GAB5Q.8.73.G07.1.454.CMB.2.raw
  modified_base (473)..(473): a, c, t, g, unknown or other
  modified_base (476)..(480): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgccctccaagtctggcacttctgcctccctggtcatatctggtctccagggtgaggatgaggctgattatactgccactcctatgacaacagcctgagtatttggctgttcggcggcgggaccaagttgaccgtcctacgtcacgcccaaggctcgccccctcggtcacctctcgttccccaccctcctcgacacgcgagctgagcggctgcaggcgcanagnnnnn

SEQ ID NO: 362952 - DNA, 521 bp, Homo sapiens
  misc_feature: GZ8MTXP02HCO3W.8.73.G07.1.454.CMB.2.raw
  modified_base (510)..(521): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggcctcaggggtctctgaccgattctctgcctccaagtctggcacttctgcctccctggtcatatctggtctccgagggtcgaggatggagggctggtatttatttactgtccacccgtcctatgaccaacacgcctgagttattgcttgttcggcggcggacagttcgaccgtctacgtcacgcccaaggcctcgccccctggtccacgttctcgttccccgcccttcgtaccgaccgtacgcgacgcgtggacgtcggggctggacgaaggcccgatacacgnnnnnnnnnnnn

SEQ ID NO: 362953 - DNA, 513 bp, Homo sapiens
  misc_feature: GZ8MTXP02G9AY2.8.73.G07.1.454.CMB.2.raw
  modified_base (211)..(211): a, c, t, g, unknown or other
  modified_base (266)..(266): a, c, t, g, unknown or other
  modified_base (328)..(328): a, c, t, g, unknown or other
  modified_base (332)..(332): a, c, t, g, unknown or other
  modified_base (502)..(513): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaangataacaacaatccggccctcaggggtctctgaccgattctctgcctccaagtcnggcacttctgccctccctggtcatatctggtctcgagggtgaggatgaggctgattattacngccncctcctatcgaactaacagcctgtagttatttggcttggttcggcggccgggtacaagttcgaccgtccacgtcagcccaaggcctcgccccctcggtcaccttctccgttcccgcccctcctccgaccacgcgacgctggacggcggcgtcggacgaggcgcagtacgnnnnnnnnnnnn

SEQ ID NO: 362954 - DNA, 598 bp, Homo sapiens
  misc_feature: GZ8MTXP02F4ADK.8.73.G07.1.454.CMB.2.raw
  modified_base (588)..(598): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcagtcggggcaggttatgatgttcattggtaccgcaggttccaggcacagccccagactcctcattaatgaataaacaacaatcggccctcgaggggtctctgaccgattctctcgcctccaagtctggctacttctcgcccttccccgtggtcatactctcggtctccgagggtgaggtatgaggtctgtattattactcgcctaccttcctatgaacaaacacgccttggtattagtttggtccttgggttaccgggcgggacgggtaacctaaggttccggtaacccgtccgtaacgtcgaacgccccgaaaggtccctccgcccccgtcggtacctacctcccgttaccgttccccctaaccccttccgtacccgaaccgtaccgccgacggtccgtcgggaaggcccggggcgtcgggaccgaaacggccggacagtacgcnnnnnnnnnnn

SEQ ID NO: 362955 - DNA, 510 bp, Homo sapiens
  misc_feature: GZ8MTXP02I2ZIJ.8.73.G07.1.454.CMB.2.raw
  modified_base (496)..(496): a, c, t, g, unknown or other
  modified_base (498)..(498): a, c, t, g, unknown or other
  modified_base (500)..(510): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccaccaggttccaggcacagcccccagactcctcattaatgaataacaacaatcggccctcaggggtctctgaccgattctctgcctccaagtctggcacttctgcctccctggtcatatctggtctcgaggggtgaggatggaggctgtatttattactgcccaccttcctaatcgaacaacacgcctgattatttggcttggtcgggcgggacgggacctagttcgaccgtcctacgtcacgcccaaggctccgcccccgtgtaccacttctccgttcccaccccttcaccgacacgcgagctgacgcggctggacaggcgananannnnnnnnnnn

SEQ ID NO: 362956 - DNA, 601 bp, Homo sapiens
  misc_feature: GZ8MTXP02FV1XR.8.73.G07.1.454.CMB.2.raw
  modified_base (207)..(207): a, c, t, g, unknown or other
  modified_base (213)..(213): a, c, t, g, unknown or other
  modified_base (276)..(276): a, c, t, g, unknown or other
  modified_base (302)..(302): a, c, t, g, unknown or other
  modified_base (310)..(310): a, c, t, g, unknown or other
  modified_base (314)..(314): a, c, t, g, unknown or other
  modified_base (590)..(601): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccccagactcctnattaangataacaacaatcggccctgagggtctctgaccgattctctgccctcaagtctggctacttcncgtccctccctggtcatatctggtcncgagggtnaggntggagctgtattatactgcctactcctatcgacaacacgtctggtattagtttggacgttggttccggggcgggtaccgggaaccgtaacggttaccgtacccgttaccgttaccgtcgaccgaccccgtaaacggcccgttcccgtccccccgttccggtaccctacccttcccgttcccggttacccccctacccccgttaccccgtaccgacccgtaccggaccgacggtcgtcggacgggcgggcgtacgggacgaacggccgacagtacgnnnnnnnnnnnn

SEQ ID NO: 362957 - DNA, 660 bp, Homo sapiens
  misc_feature: GZ8MTXP02IF028.8.73.G07.1.454.CMB.2.raw
  modified_base (649)..(651): a, c, t, g, unknown or other
  modified_base (653)..(653): a, c, t, g, unknown or other
  modified_base (655)..(660): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactctcattaatgataacaacaatcggccctcaggggtctctgaccgattctctcgcctccaagtctggctacttcctgccctccctggtctatattctggtcctccgaggggtgaggatggaggtctgtatttattactgcctacctcctatcgaacaacagtcctgtagttagtttgggtccttgggtttcggggccggggtaccggggaacccgttaaggtttacccggtacccggttacccgttaacccggtccgtacggacccccgtaaacgggtcccgttcccggtcccccccgttccgggttacccttaccccgttcccgtttccccggtttcccccccgtcccccgttccccgttacccggacccgaccggccggtacggtccgtacggaccggggtccgggggtccgtcgggaccggaaacgggcccgaacgacgtacggcnnngncnnnnnn

SEQ ID NO: 362958 - DNA, 629 bp, Homo sapiens
  misc_feature: GZ8MTXP02GBCNJ.8.73.G07.1.454.CMB.2.raw
  modified_base (618)..(620): a, c, t, g, unknown or other
  modified_base (622)..(629): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatccggccctcgaggggtctctgaccgattctctgcctcaagtctgcacttctgcctcctggtcatatctggtcctccgaggggtgaggtatggaggctgtatttattactcgcctacctcctatcgaacaacacggtccttggagtttagtttggggccttggggttcccgggcggggtacccggggtaacccgtaaacggtttccggtaccccgttacccgttaccggttcccgaacgacccccgtaagggtcccttcccgccccccgttcggttaccctacccgtttcccgttccccgttaccccctaccccctttcccgtacccgaaccgtacccggaccgacggtcgtcgggacggccggggcgtcgggacgaacggggccgatacgtagcnnngnnnnnnnn

SEQ ID NO: 362959 - DNA, 614 bp, Homo sapiens
  misc_feature: GZ8MTXP02JW9MZ.8.73.G07.1.454.CMB.2.raw
  modified_base (324)..(324): a, c, t, g, unknown or other
  modified_base (348)..(348): a, c, t, g, unknown or other
  modified_base (604)..(605): a, c, t, g, unknown or other
  modified_base (607)..(610): a, c, t, g, unknown or other
  modified_base (612)..(614): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataaacaacaatccggccctcgaggggtctctgaccgtattctctcgccctacaagtctggctacttctcgccctccctggtctatatcgtggtcctccgaggggtgaggngtggaggtctaggtatttattacncgtcctacctctatacgaacaacgtacgccttgtaagtttacgtttcgggtcgttcggggttaccgggccgggaccgggggtaaacctaaaggtttccgtaaaccccgttccgttaccgtccgaacggcccaagggtccctcccgtcccccgtcggtcctacctccgttccgttaccccaccctcccgtaccgaccgaccgcggacgccgtggaccgggcggtcgtacggggaaccgagggccgcaaacgcgcgcnngnnnncnnn

SEQ ID NO: 362960 - DNA, 537 bp, Homo sapiens
  misc_feature: GZ8MTXP02IXWTX.8.73.G07.1.454.CMB.2.raw
  modified_base (355)..(355): a, c, t, g, unknown or other
  modified_base (525)..(525): a, c, t, g, unknown or other
  modified_base (527)..(537): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcccttccctggtcatatctggtctccgaggggtgaggatggaggctgatttattactgcctactcctatgaactaacgngcctggagtttatttggcttggttcgggcgggcggtaccgagtttcgaccgtctacgtcgacgcccgaaggcctccgcccccgtcggtccaccttccgtccgtttcccccgtcccttcggaccaccgccgagcgtcggacggcgggcgtacggcgaacggcggccatgcncnnnnnnnnnnn

SEQ ID NO: 362961 - DNA, 714 bp, Homo sapiens
  misc_feature: GZ8MTXP02H3WBC.8.73.G07.1.454.CMB.2.raw
  modified_base (213)..(213): a, c, t, g, unknown or other
  modified_base (299)..(299): a, c, t, g, unknown or other
  modified_base (345)..(345): a, c, t, g, unknown or other
  modified_base (703)..(708): a, c, t, g, unknown or other
  modified_base (710)..(714): a, c, t, g, unknown or other
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcggggcaggttatgatgttcattggtaccgccaggttccaggcacacgccccagactcctacattaangaataaacaacaatccggccctcgaggggtctctgaccgtattctctgccctccaagtctggctacttctcgccctccgtgtcatntctgtctccgagggtgaggtagtggaggtcttagtatttacttacncgtacctaccttcctagtacgaaacctaacgacgtaccctggtaacgtttacgttttcgggtccgtttcgggggtttcccgggggaccgggggtacccgggggtaaacccgttaaagggttcccggtaaccccggttccccgttaacgggttccccaaaccgggtacccccgtaaacggggtccccgtacccccgtcccccccggtttacgggtaccccttacccgtttcccgtttaccccggtttacccccctacccccctttacccggtacccgtaaccccgacggccggtaacggccgttacgggacgggccggggcggttacgggaccgaaacgggccgaccgtaaacggcgcnnnnnncnnnnn

SEQ ID NO: 362962 - DNA, 704 bp, Homo sapiens
  misc_feature: GZ8MTXP02FX476.8.73.G07.1.454.CMB.2.raw
  modified_base (692)..(692): a, c, t, g, unknown or other
  modified_base (696)..(696): a, c, t, g, unknown or other
  modified_base (699)..(699): a, c, t, g, unknown or other
  modified_base (701)..(701): a, c, t, g, unknown or other
  modified_base (703)..(703): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataaacaacaatcggccctcgaggggtctctagaccgtattctctcgcctccaagtctgctacttctcgccctccgtgtcatatcgtgtctcgaggtgaggtatggaggtctagtaatttacgttactcgacctacctacctatacgaaccaacgacgtccgtaggtagtttagtttcgggtcgttgggttaccggggacggggtaccgggtaaaccgtaaacggtttcccggtacccgtacccgttaccggtaccgaaccggaccccgtaaacgggtcccttaccccgccccccgttacggttacccttacccgttcccgttaccccgtttacccccctacccccgtttaccccgttaccgaaaaccccgtccgggaccggtaacggtccggttacggggaacgggttcccgggggccgttacgggacccgggaaacgggtccccggaaaacgtaacggtacgacgcgcgaacgcncgcngcncncng

SEQ ID NO: 362963 - DNA, 554 bp, Homo sapiens
  misc_feature: GZ8MTXP02IWNSW.8.73.G07.1.454.CMB.2.raw
  modified_base (279)..(279): a, c, t, g, unknown or other
  modified_base (544)..(554): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataacaacaatcggccctcgaggggtctctgaccgattctctgccctccaagtctggcacttcncgccctccctggtcatatctggtctccgagggtgagatggaggtctgatttattactcgaccctactcctatcgaacaacacgcctggtacgtttatttcgggcttgggttcggcgggtacgggaccctaagttcgaccgtccgtacgtacacgcccgaagccgtccgcccccgtcggtcctaccgttcctccgttccccaccctcctaccgaccgacgcgacgccgtggacgtcggcgtcggacgaacggcgacgacgtacgcnnnnnnnnnnn

SEQ ID NO: 362964 - DNA, 563 bp, Homo sapiens
  misc_feature: GZ8MTXP02GBN4O.8.73.G07.1.454.CMB.2.raw
  modified_base (211)..(211): a, c, t, g, unknown or other
  modified_base (258)..(258): a, c, t, g, unknown or other
  modified_base (315)..(315): a, c, t, g, unknown or other
  modified_base (553)..(563): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgcaggttccaggcacacgcccccagactcctcattaangaataaacaacaatccggccctcgaggggtctctcgaccgattctcncgccctcaagtctgctactctcgccctccgtgtcatatctggtctcgagggtgaggntgagctatattatactgccacctcctatacgaaccaacagcctgtacgttagtttggcgttcgggttcgggacgggaccgggtaacctaaggttccgtacccgtaccttaccgtcaccggccccgaaggtcctcccgcccccgtcggtaccctccttcgtacccgttcccccaccccttcccgtacgaccgacgtccgacgcgtaggcggtcgggcgtacggacgaacggcgatagannnnnnnnnnn

SEQ ID NO: 362965 - DNA, 800 bp, Homo sapiens
  misc_feature: GZ8MTXP02GXY7C.8.73.G07.1.454.CMB.2.raw
  modified_base (269)..(269): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgccccagactcctcattaatgaataacaacaatccggccctcgaggggtctctcgaccgtattctctgcctcaagtcnggctactctcgcctacccgtgtcattatctggtctaccgagggtgaggtatggaggtcttagtatttacttacctcgtacctacccttccttaagtacgaaccaaacgtacgtacccgttaggtaacgtttaaggttttacgggtccgtttcggggtttacccgggggaccgggggtacccgggggtaaacccgttaaacgggtttacccgggtaacccgttaccccggttaacgtacccggaaccggacccccggaaacggggttccccgttaccccgggtacccccccgttacgggggttcccctaacccggtttccccgtttcccccgggtttaccccccggtccccctttaccccgggttaccccgtaaacccggtaccccggtaccgggtaaccgccggttaacggggtacccgggggtccggggacccggttacggggaacccggtaaaacggggtccccgggtaacctaaaaggtacccggggtacgtacgtacgtaacgcgtacgtacgacgtcgtctacacg

SEQ ID NO: 362966 - DNA, 518 bp, Homo sapiens
  misc_feature: GZ8MTXP02GBJC8.8.73.G07.1.454.CMB.2.raw
  modified_base (308)..(308): a, c, t, g, unknown or other
  modified_base (507)..(518): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctcaagtctggcacttctgcctccctggtcatatctgtctccagggtgaggntgaggctgtattatactgccacctcctatgacaacgagcctgagttatttggcttggttcgggcggacgggtacctaagttcgacccgtcctacgtcacgcccaaggcctcgccccctcgtccactccgttcgttccccgcccctccgtccgaccacggacgcgctggacgcggggcgtcggcgaaaggcgacacgtgnnnnnnnnnnnn

SEQ ID NO: 362967 - DNA, 517 bp, Homo sapiens
  misc_feature: GZ8MTXP02JB8RV.8.73.G07.1.454.CMB.2.raw
  modified_base (294)..(294): a, c, t, g, unknown or other
  modified_base (334)..(334): a, c, t, g, unknown or other
  modified_base (506)..(508): a, c, t, g, unknown or other
  modified_base (510)..(517): a, c, t, g, unknown or other
tcagctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgaataacaacaatcggccctcaggggtctctgaccgtattctctgcctccaagtctggctacttctgcctcccctggtccatntctggtctccagggtgaggtatggaggtctgatttatacngccatcctatgacaacagtcctgattagttggctggttcggcggtcgggacctaagttcgaccgtctacgtcacgcccaagctcgcccctgtcacctctcgttaccccacccttcctacgacaccggcgtacgctcggacggcgggcctaggacgaaggcgacaacgtcgcnnngnnnnnnnn

SEQ ID NO: 362968 - DNA, 597 bp, Homo sapiens
  misc_feature: GZ8MTXP02H6HB6.8.73.G07.1.454.CMB.2.raw
  modified_base (574)..(574): a, c, t, g, unknown or other
  modified_base (585)..(585): a, c, t, g, unknown or other
  modified_base (587)..(597): a, c, t, g, unknown or other
tcagctcgcgtgtccacgaccggtgctcgatttagctctacgctcagggtcctgggcccagtctgtactgacgcagccgccctcagtatctggggcccccagggcagagggtctccatctcctgcactgggagcagaaccagcatcgggcaggttatgatgttcattggtaccgccaggttccaggcacacgcccccagacctcctcattaatgaataacaacaatccggccctgacggggtctctgaccgtattctctgcctcaagtctggcacttctcgccctcctggtcatatcgtggtctccgaggggtgaggtagtcgagcttagatttagttactcgtacctaccctacttaagtgaaacctaaacgcgtacctggtaagtttagtttcggtccgttggttccggggccgtaccggaaccgtaaggtacgtacccgttccgtacgtccgacgtacccgacggtaccgtccccgtcccccgttcgggtaccaccttcgttccgttcccccgtccgtaccccgtcgaccgaccggccggtcgacgcggccggcgtcgggacgaacggtcncgtaaagcgcncnnnnnnnnnnn

SEQ ID NO: 362969 - DNA, 537 bp, Homo sapiens
  misc_feature: GZ8MTXP01D6GSV.44.86.H09.1.454.CMB.2.raw
  modified_base (364)..(364): a, c, t, g, unknown or other
  modified_base (496)..(496): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtactactctccgtccccctcaagagtcgtctacaccntttcgagggacacgtctatgaaccgtcttctccctgaaactcgaacctccgtcgaccgccgcggacacggtccgtttattcgtgtgcgagcgagctggtctttcgaatctagtgggctggcaccgttggtcncttcgttcttcctcagcttccaccacggcccaagttcccgg

SEQ ID NO: 362970 - DNA, 556 bp, Homo sapiens
  misc_feature: GZ8MTXP01B26S5.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccagggacggggaatggagtggattggtgacatccattatacgtggggcgacgtactactctccgtccccctcaagagtcgtctcaccntttcgagggacacgtccatcgaaacccgcttctccctagaaactcgaccctccgtcgacccgccgcggaccacggtccgtttattcgtgtgtcgaggcgagacgtggttctttcaatctagtggggccgtggccacccgttggtcacttcgttcttcctcacgcttccacgacgggcccttaagttccccgg

SEQ ID NO: 362971 - DNA, 611 bp, Homo sapiens
  misc_feature: GZ8MTXP01D6RIP.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggaggggaatggagtggattggtgacgatccattatacgtgggcgacgtactactctccgtccccctcaagacgtcgtctccacctaagtttcgaagggtaccacggttccatacgaaacccgtcctttctccctagaaacctcgaaccctccgtcgaccctccgaccggaccgtacggtccgtttactttcgtgttggcgaggtcgagtacgtggttcctttcgaaattctagtcgggggtccgtggcctaccccgttgggtcctacgttcggttccttcccgtcacgtcctttaccccaccgaacggggtccccttaagttccccggg

SEQ ID NO: 362972 - DNA, 541 bp, Homo sapiens
  misc_feature: GZ8MTXP01D0RAH.44.86.H09.1.454.CMB.2.raw
  modified_base (365)..(365): a, c, t, g, unknown or other
  modified_base (389)..(389): a, c, t, g, unknown or other
  modified_base (394)..(394): a, c, t, g, unknown or other
  modified_base (425)..(425): a, c, t, g, unknown or other
  modified_base (462)..(462): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactctccgtcccctcaagcgtcgtctacactnttcgagggacacgtccatcgaacncttcncctgaactgacctccgtcgaccgccgcgacncggtctttattcgtgtgcgaggcgagcttggtctttnaattctagtcggggctggctacccgttggtcacttcgttcttcctcacgtccttccaccgacgggtcccttgttcccgg

SEQ ID NO: 362973 - DNA, 677 bp, Homo sapiens
  misc_feature: GZ8MTXP01DZQCO.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggagggaatggagtggattggtgacatccattatacgtggggcgacgtactactctccgtccccctcaagacgtcgtctcacctntttcgagggacacgtccatcgaaacccgtcttctccctagaaacctcgaacccgtcccgtcgaacccgcccggaccggaccgtaccgggtaccgttttaactttcggtcggttcggaccggacggtcccggaagtacccgttgggttacccgttttactaaacgttccgtaaggttcgggggtcccggttcgggttcccgtacccccgttggggttaccctaaccgtttcggttcccttccccggttcctaaccggtcccttttaccccgaaccccggttaaaccggggcccccttaacgtttccccccgggg

SEQ ID NO: 362974 - DNA, 552 bp, Homo sapiens
  misc_feature: GZ8MTXP01CNMS0.44.86.H09.1.454.CMB.2.raw
  modified_base (492)..(492): a, c, t, g, unknown or other
  modified_base (503)..(503): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggctggatccggcagcccccgagggagggaatggagtggagttggtgacatcctagttatacgtggggcgacgtactactctccgtccccctcaagagtcgtctacaccaatttcgagggacacgtcatcgaaccgcttctcctagaactcgacctccgtcgaccgccgcgactacggccgtttacttcgtgttcgcgaggcgagacgtggtctttcgaatcgtagtcggggctggccnccgttggtacncttcgttcttcctcacgtccttcccacgaacgggtcccaagttccccgg

SEQ ID NO: 362975 - DNA, 608 bp, Homo sapiens
  misc_feature: GZ8MTXP01EB63Y.44.86.H09.1.454.CMB.2.raw
  modified_base (377)..(377): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttggggctggactccggcacgcccccgaggggacgggaatgggagtggagttggtgactatccattagtacgtgggcgtacgttactactctccgtcccctacaagtacgtcgtctacacctntttcgagggacacgtccagtcgaaccgtcttctaccctagaaactcgacccttccgtcgacccgccggacgactaccggtccgtttagtttcgtacgttgacggacggcgagtacgttggttcctttacaagttccgtaggtcggggccgttcggccctaccgttggtacctacgttcgttccttccctcacgtcccttacccgaccgaacggtccccttaacgtccccgg

SEQ ID NO: 362976 - DNA, 590 bp, Homo sapiens
  misc_feature: GZ8MTXP01EFGOZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccgagggagggaagtggagtggagttggtgacatcctattagtacgtggggcgacgtactactctccgtccccctcaagagtcgtctacacctgtttcgagggacacgtccatcgaacccgtcttctccctagaaactcgaccctccgtacgacccgccgacggacctacggtaccgttttatttccggtggttcggcgacggcgagacgttggttctttctaagttctagtcgggggccgttggccacccgttggtcctacgttcgttccttacctcacgtccttcccaccgttacgggccccttaagttccccgg

SEQ ID NO: 362977 - DNA, 566 bp, Homo sapiens
  misc_feature: GZ8MTXP01ECBLA.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcaccttgttggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttgggctggatccggcacgccccgaggggacgggaagtggagtggagttggtgacatcattatacgtgggcgacgtactactctccgtcccctcaagtacgtcgtctacacctntttcggaagggacacgtccaatcgaaaccgtcttctaccctagaaactcgaccctccgtcgacccgcgacgacgacggtcctttagttcgtgtgtcgaggcgagcgtggtcttcaatgtagtgggcgtgcctaccgttggtctacttgttccttcgtcagtcccttccgaccgaacgggtcccttaacgtttcccgg

SEQ ID NO: 362978 - DNA, 561 bp, Homo sapiens
  misc_feature: GZ8MTXP01EDNAM.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttggggctggatccggcagcccccgagggaggggaatggagtggattggtgacatccattatactggggcgacgtactactctccgtccccctcaagagtcgtctcaccngtttcgagggacacgtccatgaaccgcttctcctgaaactgaccctccgtcgaccgccgcggacacggtccgtttatttcgtgttgcgtaggcgagacctggtactttcgaattctagtgggggccgttgggccaccccttgggtccacttcgttcttcctcacgccttcccgaccaacgggtccccaagttccccgg

SEQ ID NO: 362979 - DNA, 576 bp, Homo sapiens
  misc_feature: GZ8MTXP01DAVOJ.44.86.H09.1.454.CMB.2.raw
  modified_base (372)..(372): a, c, t, g, unknown or other
  modified_base (440)..(440): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgcccccgagggacggggaagtgggagtggagttggtgactatcctattatacgtggggcgacgtactactctccgtccccctcaagacgtcgtctacacntttcgagggacacgtccatcgaaccgtcttctccctagaaactcgacctccgtcgaccgccgcggacncggtcgtttattcgtgtgtcgaggcgagacgttggtctttcaattctaggtggggccgtggctacccgttgggtactacgttcgttccttcctcacgtcctttacccgaccgacgggtccccttaagtttccccgg

SEQ ID NO: 362980 - DNA, 553 bp, Homo sapiens
  misc_feature: GZ8MTXP01D0HDY.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggaggggaatggagtggattggtgacatccattatacgtggggcgacgtactactctccgtccccctcaagagtcgtctacacctntttcgagggacacgtccatcgaaccgcttctccctgaaactgaccctccgtgaccgccgcgacacggtccgtttatttcgtgttgcgtaggcgagactggttctttcgaattctagtgggggcctgggcctacccgttggtcacttcgttcttcctcagtccttccaccgttacgggcccaagttcccgg

SEQ ID NO: 362981 - DNA, 587 bp, Homo sapiens
  misc_feature: GZ8MTXP01EOIAB.44.86.H09.1.454.CMB.2.raw
  modified_base (355)..(355): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgcccccgagggagggaagtggagtggagttggtgactatcctattagtacgtggggcgacgttacgtactctccgtccccctnaagagtcgtctccacctgtttcgagggacacgtccatcgaaccgtcttcctccctagtaaactcgaacctcccggtcgacccgccgacggaccacggtccgtttatttcggtgttcggcgagggcgtagacgttggtctttcaattctagtggggtccgttggcctacccgttggtcacgttcgttccttcctcacgtccttcccgacgttacgggtcccttcgttccccgg

SEQ ID NO: 362982 - DNA, 571 bp, Homo sapiens
  misc_feature: GZ8MTXP01DA902.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggaggggaagtgggagtggagttggtgacgatccattatacgtggggcgacgtacgtactctccgtccccctcagagtcgtctacacctntttcgagggacacgtccatcgaaccgcttctccctagaaactcgaccctccgtcgaccgccgcggaccacggtccgtttactttcgtcgttggcgtaggcgagacttggttctttcgaattcgtagtcgggggcgtgggctaccccgttggtcacgttgttccttcctcacgccttccaccgaggtccccaagttccccgg

SEQ ID NO: 362983 - DNA, 596 bp, Homo sapiens
  misc_feature: GZ8MTXP01BJ2VV.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggtccaggactggtgaggccttcgggaaccctgtctctcatctgcactgtctctggagtttccatcagttctgatcattctggggctggatccggcacgcccccgaggggaggggaagtgggagtggagttggtgacatccattatacgtggggcgacgttactactctccgtccccctcaagagtcgtctcacctntttcgagggacacgtccatcgaacccgtcttctccctagaactcgaccctccgtcgaccgccgcgaccgtacggtccgtttatttcgtggttcgcgaggcgagacgttggttctttctaattcgtagtcgggggtccgtcggcctaccccgttgggtcctacgttcgttcttcccgtcacgtcctttacccgacccgttaacggggtccccttaacgtttccccggg

SEQ ID NO: 362984 - DNA, 609 bp, Homo sapiens
  misc_feature: GZ8MTXP01BQZKG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacgcccccgaggggagggaagtggagtggagttggtgacatccattatacgtggggcgacgtacgtactctccgtccccctcgaagacgtcgtctaccacctgtttcgagggtacaccgtccatcgaaccgtcttctcctgaaacctcgaccctaccgtcgacccgccggacggaccacggtccgtttattcgtgttggccgtaggccgtagtaccgttgggttacctttactaaagttcctaggtcgggggtcccgttgggcctaccccggttgggtcccacttcggttccttccgttcacgtccttacccacgaacggggtccccttaagttccccgg

SEQ ID NO: 362985 - DNA, 545 bp, Homo sapiens
  misc_feature: GZ8MTXP01D4CHR.44.86.H09.1.454.CMB.2.raw
  modified_base (362)..(362): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtcccctcaagagtcgtctcacctntttcgagggacacgtccatcgaaccgcttctccctgaaactgaccctccgtgaccgccgcggacacggtctttatttcgtgttgcgaggcagactggttctttcaatctagtcggggcctgggctacccgttggtcacgttgttcttcctcacgccttccaccgacggtcccaagttccccgg

SEQ ID NO: 362986 - DNA, 552 bp, Homo sapiens
  misc_feature: GZ8MTXP01EALUA.44.86.H09.1.454.CMB.2.raw
  modified_base (367)..(367): a, c, t, g, unknown or other
  modified_base (507)..(507): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggaggggaagtggagtggattggtgacagtaccatttatacgtggggcgacgtactactctccgtccccctcaagagtcgtctacacctntttcgaggggtacacgttccatagaacccgtcttctcccctagaaactgaccttccgtcgaccgccgcggacacggtccgtttatttctgttgcgaggcgagctggtctttcaatctagtgggctggcacccgttggtcncttcgttcttccgtcagtcttccacttacgggcccaagttcccgg

SEQ ID NO: 362987 - DNA, 542 bp, Homo sapiens
  misc_feature: GZ8MTXP01CP5UG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccagggactggtgaggccttcgggaaccctgtctctcatctgcactgtctctggatttccatcagttctgatcattcttggggctggatccggcagcccccagggaggggaatggagtggattggtgacatccattatactgggggcgacgtactactctccgtccccctcaagagtcgtctcacccaatttcgaggggacaacgtcccatgaaacccgcttctccctgaaactgaccctccgtgaccgccgcgacacggccgtttattcgtgtgcgaggcgagactgggtctttcaatctagtggggcccgtgggcacccttgggtcacttgttcttcctcagcttccacaaggcccaagtcccgg

SEQ ID NO: 362988 - DNA, 512 bp, Homo sapiens
  misc_feature: GZ8MTXP01EFQC8.44.86.H09.1.454.CMB.2.raw
  modified_base (304)..(304): a, c, t, g, unknown or other
  modified_base (365)..(365): a, c, t, g, unknown or other
  modified_base (368)..(368): a, c, t, g, unknown or other
  modified_base (372)..(372): a, c, t, g, unknown or other
  modified_base (378)..(378): a, c, t, g, unknown or other
  modified_base (399)..(399): a, c, t, g, unknown or other
  modified_base (409)..(409): a, c, t, g, unknown or other
  modified_base (483)..(483): a, c, t, g, unknown or other
  modified_base (492)..(492): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaacagacatggcatgcactgggtccncaggctccaggcaagggctgggagtgggtgcacttatatggtatgatggaaaataataatntangtanattcgngaaggcatcacatctacaganacaatcgaanaacacatagtatctaggaaatgaaatacgctagagagccgaggacaaggcttgtcttacgatggttgcgttagngagtcgggntcggttaggaacttaagaag

SEQ ID NO: 362989 - DNA, 519 bp, Homo sapiens
  misc_feature: GZ8MTXP01DZEAW.44.86.H09.1.454.CMB.2.raw
  modified_base (281)..(281): a, c, t, g, unknown or other
  modified_base (411)..(411): a, c, t, g, unknown or other
  modified_base (422)..(422): a, c, t, g, unknown or other
  modified_base (469)..(469): a, c, t, g, unknown or other
  modified_base (486)..(486): a, c, t, g, unknown or other
  modified_base (488)..(488): a, c, t, g, unknown or other
  modified_base (496)..(496): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctggggaggtccctgagactctcctgtgtagcgtctggattcaccttnaacagacatggcatgcactgggtcccgcaggcctaccgaggcaagggctggagtgggtgcattatatggtatgatggaaaataataatattatgtagattcgtaggaagggccattcacatctccaaganacaatcgaaanaacacatatatagtagaaatagaatagctagagagacgagacaacgnttgtacttacgtagtgngngagaaggngtgggctggagtaagttaagaag

SEQ ID NO: 362990 - DNA, 563 bp, Homo sapiens
  misc_feature: GZ8MTXP01D7X9G.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtactactctccgtccccctcaagagtcgtctacaccntttcgagggacacgtccatcgaaccgcttctccctgaaactcgacctccgtgaccgccgcgacacggccgtttatttcgtgtgcgaggcgagaccgtggtactttcaaatccgtagtggggcccgtgggccacccgttgggtccacttcgttccttcctcaacgtcttcccaccgaacgggtccccaagtttccccggg

SEQ ID NO: 362991 - DNA, 607 bp, Homo sapiens
  misc_feature: GZ8MTXP01DSVX8.44.86.H09.1.454.CMB.2.raw
  modified_base (570)..(570): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtggggctggatccggcacgcccccgaggggaggggaagtggagtggagttggtgacgatccattagtacgtggggcgacgtactacctctccgtccccctcgaaagacgtcgtcctacacctctttcgagggacacgtccatcggaacctcttctaccctagaacctcgaccctccgtacgacccgccggacgaccgtacgtaccgtttagtttcgtgttcggcggacggccggtagaccgttggttcctttacaagttcgtacggtcgggggtcccgttggccgtacccgttggtcctacgttcgttcttccctcncgtccttcccgacgaacgggtcccaacgtttccccgg

SEQ ID NO: 362992 - DNA, 539 bp, Homo sapiens
  misc_feature: GZ8MTXP01BYEY3.44.86.H09.1.454.CMB.2.raw
  modified_base (364)..(364): a, c, t, g, unknown or other
  modified_base (513)..(513): a, c, t, g, unknown or other
  modified_base (531)..(531): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaagtggagtggattggtgacatccattatacgtgggggcgacgtactactctccgtccccctcagagtcgtctacaccntttcgagggacacgtccatgaacccgcttctccctgaaactgacctccgtgaccgccgcgacacggccgtttattcgtgtgcgaggcgagctggttctttcaattctagtgggggccgtggccacccgttggtcacttgttcttcctcngcttccaccacgggcccngttcccgg

SEQ ID NO: 362993 - DNA, 589 bp, Homo sapiens
  misc_feature: GZ8MTXP01A1CAO.44.86.H09.1.454.CMB.2.raw
  modified_base (378)..(378): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacggcccccgaggggacggggaagtgggaggtggagttggtgacatcctattagtacgtggggcgacgtactactctccgtccccctacaagacgtcgtctacacctnttcgagggacacgtccactcgaaccgtcttctccctagaaactcgaccctccgtcgacccgccgacggacgaccggtccgtttacttcggtgtgccgaggcgtagacgttggttcctttcaagttcgtacggtcggggccgtggcctaccgttgtcctacttcgttcttccctcacgtccttccaccgacgggtcccttaacgttccccgg

SEQ ID NO: 362994 - DNA, 603 bp, Homo sapiens
  misc_feature: GZ8MTXP01D7QE0.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggctggatccggcacgccccgaggggacgggaagtggaggtggtagttggtagactatacctattatacgtgggcgacgtactactctccgtcccctcaagtcgtcgtctacactgttcgaggacacgtacatacgaaccgtcttctaccctagaaactcgacctcgtacgaccgccgacgacacggtctttacttcgtgtgcgaggcgacgtcgttggttactttctaaagttcgtaggtcggggcccgttcggcctacccgttggtacctacgttcggttccttcccgttcacggtccctttacccgaccggttaacggtccccttaacgtttcccccgg

SEQ ID NO: 362995 - DNA, 573 bp, Homo sapiens
  misc_feature: GZ8MTXP01DAGI0.44.86.H09.1.454.CMB.2.raw
  modified_base (362)..(362): a, c, t, g, unknown or other
  modified_base (445)..(445): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccgagggagggaatggagtggatggtgacatccattatacgtgggcgacgttactactctccgtccccctcaagagtcgtctacacctntttcgagggacacgtcagtcgaaccgcttctcctagaaactcgacctccgtcgacccgccgacgacacggtccgtttattcgngtgcgaggcgtaagcgtggttcttacaagtcctaagtcgggggtccttcgggcctaccccgttgggtccaacgttcgttccttccgtcacgtcccttaccaccgttacgggccccttaagttccccgg

SEQ ID NO: 362996 - DNA, 578 bp, Homo sapiens
  misc_feature: GZ8MTXP01DZTLC.44.86.H09.1.454.CMB.2.raw
  modified_base (368)..(368): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccatttatacgtggggcgacgttactactctccgtccccctcaagagtcgtctacaccntttcgagggacacgtcactgaaccgcttctcctgaaactcgacctcgtcgaccgcgcgacacggtcctttattccgtgtgcgtaggcgagacttggtacctttcgaaatcgtacgtgggggcccgttgggcctacccgttggtcctacttcggttcttccctctacggtcccttccaacccgttaacgggccccttaacgtttccccggg

SEQ ID NO: 362997 - DNA, 568 bp, Homo sapiens
  misc_feature: GZ8MTXP01AU7AE.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacgggaagtggagtggagttggtgacatccattagtacgtggggcgacgtactactctccgtcccctcagagtcgtctacactnttcgagggacacgtcatcgaaccgcttctcctagaaactgacctccgtcgaccgccgcgacacggtccgtttattccgtgtcgcgaggcgagtacgtggtctttcaattccgtagtcggggccgtgggcctacccgttggtcctacgttcgttccttcctcacgtccttaccaccgttaacgggtcccttaacgttccccgg

SEQ ID NO: 362998 - DNA, 563 bp, Homo sapiens
  misc_feature: GZ8MTXP01DIKBD.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtccccctcagagtcgtctacacctntttcgagggacacgtccatcgaaccgcttctccctagaaactcgacctccgtcgaccgccgcggacacggtccgtttatttcgtgtgcgaggcgagactggtctttcaattctagtgggggccgtgggctacccgttgggtccacgttcgttcttccctcacgtccttcccgaccgaacggggtccccaagttccccggg

SEQ ID NO: 362999 - DNA, 539 bp, Homo sapiens
  misc_feature: GZ8MTXP01D5KFC.44.86.H09.1.454.CMB.2.raw
  modified_base (263)..(263): a, c, t, g, unknown or other
  modified_base (507)..(507): a, c, t, g, unknown or other
  modified_base (509)..(509): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgttggtggcagctcccagatgggtcctgtcccaggtgcagctgcaggagtcgggcccaggactggtgaggccttcgggaaccctgtctctcatctgcactgtctctggagtttccatcagttctgatcattctggggctgganccggcacgcccccgagggaggggaatggagtggattggtgacatccattatacgtgggcgacgtactactctccgtcctcaagagtcgtctcaaccatttcgagggacacgtccatcgaaccgtcttctcctagaactcgacctccgtcgaccgcgcggacacggtctttattcgtggtgcgaggtcgagacgtggtactttcaatctagtggggccgtggccaccgtgttcacttgttcttcncngtcctccacaggccctaagttcggttcccc

SEQ ID NO: 363000 - DNA, 557 bp, Homo sapiens
  misc_feature: GZ8MTXP01BU49J.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatcggcagcccccagggacggggaatggagtggattggtgacatcattatacgtggggcgacgtactactctccgtccccctcaagagtcgtctacacctaatttcgagggacacgtccatcgaacccgcttctccctgaaactgaccctccgtcgaccgccgcggacaccggtccgtttattcgtgtcgcgaggcgagacttggtctttctaatctagtggggccgtggccaccgttggtcacgttgttcttcctcacgctttcccgaccgttaacgggtcccaacgttcccgg

SEQ ID NO: 363001 - DNA, 582 bp, Homo sapiens
  misc_feature: GZ8MTXP01EPNL6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtggggctggatccggcacgccccgagggagggaagtggagtggagttggtgacatcattagtacgtggggctacgtactactctccgtcccctcaagtacgtcgtctaccacctgtttcgagggacacgtccagtcgaacccgtcttctccctagaaactcgaccctccgtcgaccgccgcgaccacggtcgtttattcggtgtgcgtaggcgtagacgttggttactttcgaaattcgtagtcggggtaaccgtggccctaccgttggtctacgttcgttccttcctcacgtcccttcccgacgaaccgggtcccttaacgttccccgg

SEQ ID NO: 363002 - DNA, 567 bp, Homo sapiens
  misc_feature: GZ8MTXP01CNPDR.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccccctcagagtcgtctcaccntttcgagaacacgtccatgaacccgcttctccctgaaactgacctcgtcgaccgccgcgacacggtccgtttatttcgtgttgcgtagggcgagacgttgggtccttttcaattctagtgggggcccttgggcctacccttgggtccacgttcgttccttcccttcacgtcctttccacccaacggggtccccaacgtttccccggg

SEQ ID NO: 363003 - DNA, 562 bp, Homo sapiens
  misc_feature: GZ8MTXP01C981A.44.86.H09.1.454.CMB.2.raw
  modified_base (346)..(346): a, c, t, g, unknown or other
  modified_base (358)..(358): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatcggcagccccagggagggaatggagtggattggtgacatcattatacgtggggcgacgtactactctccgtccccctcaagngtcgtctcactntttcgagggacacgtccatgaaccgcttctccctgaaactgacctccgtcgaccgccgcggacacggtccgtttacttcgtgtgcgaggcgagacttggtctttcaattcgtagtcgggggccgttggcgtaccccttgggtccacgttcgttcttcctcgacgtcctttacccgacccgaacgggtccccaagtttccccggg

SEQ ID NO: 363004 - DNA, 559 bp, Homo sapiens
  misc_feature: GZ8MTXP01DU2YI.44.86.H09.1.454.CMB.2.raw
  modified_base (303)..(303): a, c, t, g, unknown or other
  modified_base (497)..(497): a, c, t, g, unknown or other
  modified_base (551)..(551): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaagtgcagctgcaggagtcgggcccaggactggtgaggccttcgggaaccctgtctctcatctgcactgtctctggagtttccatcagttctgatcattcttgggctggatccggcacgcccccgagggaggggaatggagtggagttggngacatcctattatacgtggggcgacgttactactctccgtccccctcgaagagtcgtctacacctgtttcgagggacacgtccatcgaaacccgtcttactccctagaaactcgaccctccgtcgaccgccgcggacacggtcctttagttccgtgttggcgtaggcgagtacgtggttacttctaatcgtagnggggccgtggcaccgttggtcacttgttcttctcagtccttccacgacggtccncgttcccg

SEQ ID NO: 363005 - DNA, 547 bp, Homo sapiens
  misc_feature: GZ8MTXP01EJFVC.44.86.H09.1.454.CMB.2.raw
  modified_base (365)..(365): a, c, t, g, unknown or other
  modified_base (514)..(514): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggtcttcgggaaccctgtctctcatctgcactgtctctggatttccatcagttctgatcattcttggggctggatccggcagcccccaggggaggggaagtggagtggattggtgacagtccattatacgtgggggcgacgtactactctccgtccccctcaagagtcgtctcaccntttcgagggacacgtccatcgaaaccgcttctccctgaaactcgacctccgtgaccgccgcgacacggcgtttattcgtgtcggcgaggcgagacgtggttctttcaatcgtagtggggccgttggccacccgttggtcacgttgttcnctcagccttccaccaagggcccttaagtcccgg

SEQ ID NO: 363006 - DNA, 544 bp, Homo sapiens
  misc_feature: GZ8MTXP01C5W8I.44.86.H09.1.454.CMB.2.raw
  modified_base (364)..(364): a, c, t, g, unknown or other
  modified_base (514)..(514): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtactactctccgtccccctcaagagtcgtctacaccntttcgagggacacgtccatgaaccgcttctccctgaaactgacctccgtcgaccgccgcggacacggtccgtttatttcgtgtgcgaggcgagactggtctttcaatctagtggggccgtgggctacccgttggtcacttgttcttcctnagtccttccaccacgggtcccaagtcccgg

SEQ ID NO: 363007 - DNA, 565 bp, Homo sapiens
  misc_feature: GZ8MTXP01D1A8K.44.86.H09.1.454.CMB.2.raw
  modified_base (279)..(279): a, c, t, g, unknown or other
  modified_base (307)..(307): a, c, t, g, unknown or other
  modified_base (452)..(452): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcaccttnaaacagacatggcatgcacgtgggcccnccagggcctccgaggcaaaggggctgggagtgggtgctacttatacgtgggtaatgaataggggaaaaaattaaataattatttaatggtaagtatttccgggagaaacgggcctattcaccatctacaagagacaatacgaaanaacacataatatagtaagaaatagaatagacagagacgacgacgacgaacgtcttgtacttacgtacgtgcgcgagaaggtaggtggggctcggttaggtaacgttaacgaag

SEQ ID NO: 363008 - DNA, 605 bp, Homo sapiens
  misc_feature: GZ8MTXP01D0XRA.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggaggggaagtgggagtggagttggtgacgataccattatacgtggggcgtacgtactactctccgtccccctcagtacgtcgtctccacctntttcgacgggtacacgtccatcgaaccgtcttctccctagaaactcgacctccgtcgaccgccgcggacaccggtcgtttactttcggtgttcggcggtacggcgagtacgttggttctttctaattcgtacgtcgggggtccgtcggcctaccccgttgggtctaccgttgttccttccgtctacggtcccttcccgaccgaacgggtccccttaacgtttccccggg

SEQ ID NO: 363009 - DNA, 633 bp, Homo sapiens
  misc_feature: GZ8MTXP01DXK3L.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtatttccatcagttctgatctattcgttggggctggatccggcacgccccgagggagggaagtggagtggtagttggtgacataccatttagtacgtggggacgtacgttactactcctccgtccccctacaagtgtccgtctaccactgtttcgagggacctacgtccagtacgaaacccgtcttcctaccctagaaaccttcgaaccgttccgacgacccgccggcgtaccgacggttccgtttacttcggtgtcggccgaggcgtagtcgttcgggttactttcgaagttcgtagtcgggggtaaccctcgggttcctaccccgttgggtccacgttcggttccttacccgtgaccgtccgttacccgaccgttaacgggtccccttaacgtttccccgg

SEQ ID NO: 363010 - DNA, 718 bp, Homo sapiens
  misc_feature: GZ8MTXP01EPHEV.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggtccaggactggtgaggccttcgggaaccctgtctctcatctgcactgtctctggtatttccatcagttctgatctattcgtggggctggatccggcacgccccgagggagggagtggagtggattggtgacatcattagtacgtgggcgacgtactactcctcccgtcccctacaagacgtccgtctaccacctgtttcgaagggaccacgtccatcgaacccgtcttacctcccgtagaaacctcgaacccgttcccgtacgaccccgccggaccggaccgtaccgggttaccgttttaacgtttccggtggttcggaccggtacgggccgtaaggtacccgttgggtttacctttacgtaaacgtttccgttaacgggttccggggggtcccgttcggggaccccgttaaccccggttcggggttaccctaacccggtttccggtttccccttccccgttaacccgtaccgggttcccctttaccccggaaaccccggttaaaccggggggtccccccgttaacgggttttcccccccgggg

SEQ ID NO: 363011 - DNA, 551 bp, Homo sapiens
  misc_feature: GZ8MTXP01BWBT8.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggcggggaatggagtggattggtgacagtccattatacgtgggggcgacgtacgtactctccgtccccctcaagacgtcgtctaccaccntttcgaagggacacgtccatgaaccgcttctcctagaaactgaccctccgtgaccgccgcgacacggccgtttattcgtgttggcgaggcgagaccgtggtctttcgaattcagtcggggctggctacccttggtcacttcgcttcctcacgccttcccgaccacgggtcccaagttcccgg

SEQ ID NO: 363012 - DNA, 686 bp, Homo sapiens
  misc_feature: GZ8MTXP01EHQJQ.44.86.H09.1.454.CMB.2.raw
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcaggagggtcagcatctcctgcagttgggagcggctaccaacgaggcgggggtctagggttttgatgttacaagtggtaccagcaacttccgaaggaacacgaccccaaatcgctactatttacgactaacacctacgttccggccctcgacggggtccctagaccgtacttcctacgacggtcctacccgaaaacggttccgtcgggtaccctaacccgttccgacccggtcccccttccccggtacgggtacccctaacgttcccgtaccggttcggggcccttacccggagggtccgttagggaacggtagtcggaacggtcttagtaactttacgttacgtcggtaccctaaggtacccttagtcgtaacgtaagttacgtccgtaggtacgttggtcggtttggggttcggttcgggacgggacgggtaccgttaagggttcgttaccggtcgtaggtccgacggcccgacgtcccgttccggtccccg

SEQ ID NO: 363013 - DNA, 569 bp, Homo sapiens
  misc_feature: GZ8MTXP01BLUK5.44.86.H09.1.454.CMB.2.raw
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccccgagggacggggaagtgggagtggagttggtgacagtccattatacgtggggcgacgtactactctccgtccccctcaagacgtcgtctcacctnttcgagggacacgtccatcgaaccgtcttctccctgaaactgacctccgtcgaccgccgcgacgacgtcgtttacttcgtgtgcgtaggcgagacgttggtctttcgtaatcgtagtcggggtccgtggcctacccgttcggtccgacttgttccttcctcacgccttccaccgaacgggcccttaacgttccccgg

SEQ ID NO: 363014 - DNA, 549 bp, Homo sapiens
  misc_feature: GZ8MTXP01BP0TO.44.86.H09.1.454.CMB.2.raw
  modified_base (362)..(362): a, c, t, g, unknown or other
  modified_base (426)..(426): a, c, t, g, unknown or other
  modified_base (453)..(453): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatcggcagcccccagggagggatggagtggattggtgacagtccattatacgtgggcgacgtacgtactctccgtccccctcaagagtcgtctccacctntttcgagggacacgtaccatgaacccgcttctccctgaaactgacctccgtgaccgcgcggacncggtccgttatttcgtgtgcgaggcgngacgtggtcttcaagtcctagtcgggccgtgcacccgttggtctacttgttcttcctcgacgccttccgacccaacgggtccccaagttccccggg

SEQ ID NO: 363015 - DNA, 565 bp, Homo sapiens
  misc_feature: GZ8MTXP01B60U5.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggacggggaagtggagtggagttggtgacatccattatactggggcgacgtactactctccgtccccctcaagagtcgtctcaccntttcgagggacacgtccatgaacccgcttctccctgaactgacctccgtcgaccgccgcggacacggtccgtttacttcgtgtgcgaggcgagacgtggttctttcaatctagtggggccgttgggctaccccgttgggtccacgttcgttcttccctcacgtcctttcccaccgaacggggtccccaacgtttccccggg

SEQ ID NO: 363016 - DNA, 549 bp, Homo sapiens
  misc_feature: GZ8MTXP01ERWYF.44.86.H09.1.454.CMB.2.raw
  modified_base (344)..(344): a, c, t, g, unknown or other
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccccctnaagagtcgtctacaccntttcgagggacacgtccatcgaaccgcttctcctagaaactgacctccgtcgaccgccgcgaccacggtccgtttattcgtgtgcgaggcgagactggtactttcaattctagtggggccgtggccaccgttggtcacgttcgttcttcctcacgtccttccgacaacgggtcccttaagttccccgg

SEQ ID NO: 363017 - DNA, 601 bp, Homo sapiens
  misc_feature: GZ8MTXP01B86M5.44.86.H09.1.454.CMB.2.raw
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggagtttccatcagttctgatctattcgttggggctggactccggcacgcccccgagggacggggaagtgggagtggagttggtgacatccattatacgtggggcgtacgtactactctccgtccccctcagagtcgtctacacctntttcgagggacacgtcatcgaaccgtcttctccctacgaaactcgaccctccgtcgacccgtccgacggactacggtccgtttactttcgtggttcggcgagggcgagtacgttgggttcctttctaacttcgtagtcgggggtccgtggccgacccgttggtacctcgttcgttccttccctcaccggtccttcccgaccgaacgggtccccttaacgtttccccggg

SEQ ID NO: 363018 - DNA, 608 bp, Homo sapiens
  misc_feature: GZ8MTXP01COHJY.44.86.H09.1.454.CMB.2.raw
  modified_base (352)..(352): a, c, t, g, unknown or other
  modified_base (370)..(370): a, c, t, g, unknown or other
  modified_base (404)..(404): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggagggaagtggagtggagttggtgacatccattatacgtgggggcgtacgtactactctccgtccccctnaagagtcgtctacacctntttcgagggacacgtccatcgaacccgtcttccnccctagaaacctcgaccctcggtcgacccgccggacgaccacggtccgtttattcggtgtcggcgaggcgagtacgtggttccttactaacgttcgtaggtcggggccgtcggcctacccgttggtacctcgttcggttccttcccgtaacgaccgtcccgttacccgaccggaaccggggtccccttaacggtttcccccggg

SEQ ID NO: 363019 - DNA, 557 bp, Homo sapiens
  misc_feature: GZ8MTXP01D0Y9S.44.86.H09.1.454.CMB.2.raw
  modified_base (357)..(357): a, c, t, g, unknown or other
  modified_base (472)..(472): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggcaaccctgtctctcatctgcactgtctctggagtttccatcagttctgatcattcgtgggctggatccggcacgcccccgagggagggaatggagtggattggtgacatccattatacgtggggcgacgtactactctccccgtcctcaagctcgtctcnccgtatttcgagggacacgtcatcgaaccgcttctccctagaaactcgacccttccgtcgacccgccgcgacacggtccgtttagttcgtgtcgcgaggcgagtactggtcttanaatccgtagtcgggggccttgggccttaccgtggtccacgttcgttccttcctcaacgtcttaccaccgtaacggccctaaccgg

SEQ ID NO: 363020 - DNA, 589 bp, Homo sapiens
  misc_feature: GZ8MTXP01E0AH1.44.86.H09.1.454.CMB.2.raw
  modified_base (352)..(352): a, c, t, g, unknown or other
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggagggagtggagtggattggtgacatccattatacgtggggcgacgtactactctccgtccccctcaagngtcgtctcacctntttcgagggacacgtccatcgaacccgtcttcctccctagaaactcgacccttcccgtcgacccgccggacggacctaccggtccgtttaatttccgtgttcggcgaggcgagacgttggttctttcaatcgtagtcggggccgttggccacccgttggtcctacgttcgttccttccgtcacgtcccttaccgacccgaacgggtccccttaagttccccggg

SEQ ID NO: 363021 - DNA, 569 bp, Homo sapiens
  misc_feature: GZ8MTXP01B0JIT.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctccagatgggtcctgtcccaggtgcagctgcaggagtcgggcccaggactggtgaggccttcgggaaccctgtctctcatctgcactgtctctggatttccatcagttctgatctattcgttggggctggactccggcacgccccgagggaggggaagtggagtggagttggtgacataccattatacgtgggcgacgtactactctccgtccccacaagagtctctcaccnttcgagggacacgtccatcgaaccgcttctccctagaaactcgacctccgtcgaccgccgcggacaccggtcgtttattcgtagtgcgaggcagtactggttacttcaattctagtcggggccgttgggcctacccgttggtacctcgttcgttccttcccgtcacgtccttcccaccgaaacgggccccttaagtttccccgg

SEQ ID NO: 363022 - DNA, 606 bp, Homo sapiens
  misc_feature: GZ8MTXP01AS3DR.44.86.H09.1.454.CMB.2.raw
  modified_base (457)..(457): a, c, t, g, unknown or other
  modified_base (576)..(576): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacgcccccgaggggacgggaagtgggagtggattggtgacatccattagtacgtggggcgtacgtactactcgtccgtccccctacgagacgtcgtctaccacctgtttcgacgggacctaccgtcctatcgaacccgtcttcctccctagaaaccgtcgaccctcgtacgacccgcccgacgacnccggtccgtttattcgtgtcggcgtaggcgtagtccgttgtccttgaactcgtcggtggggtccgtcggccgtacccgttgggtacctacgttcgttccttccgtcacgttcctacccnccggaacgggtccccttaacgtttccccgg

SEQ ID NO: 363023 - DNA, 558 bp, Homo sapiens
  misc_feature: GZ8MTXP01C9DQK.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaagtggagtggagttggtgacatccattatacgtggggcgacgtactactctccgtcccctcaagagtcgtctcaccntttcgagggacacgtccatcgaaccgcttctcctgaaactgacctcgtcgaccgccgcgacacggcctttattcgtgttgcgaggcgagactggttctttcaattctagtggggcctggcctacccttggtctacgttcgttccttcccgtcacgtcctttacccaccgaacgggtccccaagtttccccgg

SEQ ID NO: 363024 - DNA, 580 bp, Homo sapiens
  misc_feature: GZ8MTXP01D9USD.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacggcccccgagggagggaagtggagtggagtggtgacatcattatacgtgggcgacgtactactctccgtcccctcaagacgtcgtctacactgtttcgagggacacgtccatcgaacctcttcgtccctagaaactcgacctccgtcgaccgccgcgacgacggtccgtttattcgtgtcgcgacggcgagtacgttggttctttacgtaattcgtacggtcggggccgtgggcctacccgttggtcctacgttcgttcccttccgtcacgtccttcccgaccgaacgggtccccaacgtttccccgg

SEQ ID NO: 363025 - DNA, 578 bp, Homo sapiens
  misc_feature: GZ8MTXP01BWWEV.44.86.H09.1.454.CMB.2.raw
  modified_base (282)..(282): a, c, t, g, unknown or other
  modified_base (546)..(546): a, c, t, g, unknown or other
  modified_base (554)..(554): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcggtggtccgagccgtgggagtccctgagactctcctgtgtagcgtctggattcaccttnaacagacatggcatgcacgtggggtcccgccagggcctccgagggccaagggggactggggaggtggggtggctaacgttatacgtgggtatggataggaaaagtaaataatatttagtgtaacgtattccggtagaaacgggtcctaattccaaccattcctaccaagacgaacaagttacggaaataaatacaacttaatatacgtaggaaatgaatagcctagagagccgaggacaacggtcttggtcttactagtgttgngagaaggnggtcggctggagtaagttaagaag

SEQ ID NO: 363026 - DNA, 581 bp, Homo sapiens
  misc_feature: GZ8MTXP01AGJHT.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttcatcagttctgatcattcttggggctggatccggcacgcccccgagggagggatggagtggattggtgacatccattatacgtggggcgacgtactactctccgtccccctcagagtccgtctaccacctntttcgagggacacgtccatcgaaccgcttctccctagaaactcgaaccctccgtcgaccgccgcggaccacggtccgttttatccgttgtcgcgacggcgagacgtggttcctttacgtaatccgtagtcggggccgttggcctaccccgttggtcctacttcggttccttcccgtctacgccttccgacccgaacgggtccccttaagttccccgg

SEQ ID NO: 363027 - DNA, 638 bp, Homo sapiens
  misc_feature: GZ8MTXP01BJX57.44.86.H09.1.454.CMB.2.raw
  modified_base (385)..(385): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggcttggactccggcacgcccccgaggggagggaatggagtggagttggtgacatccattagtacgtgggggacgtacgttactactctccgtcccccttacaacgtagtccgtctaccaccgtntttcgaagggacctaccgtaccactacgaacccgtctttcctaccctagaaacctcgaacccttccggtacgacccgcccgtcgacctacggtcctttttacttcgtcgttggccgaggcgagtcgtggtttcctttacgaaattcgtacggtcggggtcccgtggttacctcccgttgggtcctacgttcgttcccttccgtaacgtacgtccctttacccgaccgaacgggtccccttaaggtttcccccg

SEQ ID NO: 363028 - DNA, 632 bp, Homo sapiens
  misc_feature: GZ8MTXP01DKH9G.44.86.H09.1.454.CMB.2.raw
  modified_base (362)..(362): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtatttccatcagttctgtatctattcgttggggctggatccggcacgcccccgagggagggaagtggaggcggtagttggtgacatcctattagtacgtggggcgtacgtacgtactctccgttccccctcaagngtccgtctaccacctgtttcgacgggacacgtccagtcgaacccgtcttcctccctagaaaccgtcgaccctccgtacgacccggccgtcggactacggtccgtttatttcgtcgtcggcgtacggcgtaacgtacgttgggttacctttacgtaaacttcgtaaggtccgggggtccgtcgggttccgtacccggttggtccctacgttcggttccttccgtcacggtcccttaccaccggttaccgggtcccttaacgtttccccggg

SEQ ID NO: 363029 - DNA, 617 bp, Homo sapiens
  misc_feature: GZ8MTXP01BPTU7.44.86.H09.1.454.CMB.2.raw
  modified_base (396)..(396): a, c, t, g, unknown or other
  modified_base (463)..(463): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgagggacggggaatgggagtggagttggtagactatccctagtttagtacgttgggggaccgtacgttacgttacctcctcccggtccccctacgaacgtacgtcgtcctacacctnttcgaagggacacgtcatcgaaccgtcttctcctagaaactcgaccctaccgtcgaccgccgcgacncggtctttacttcgtcgtgccgaggcgagtacgtggttactttcaatcgttagtcggggtcccgttggcccgtaccgttggtcctaacgttcggttccttcccgtctacggtcccttacccgaccgaaccggggtccccttaacgttccccggg

SEQ ID NO: 363030 - DNA, 547 bp, Homo sapiens
  misc_feature: GZ8MTXP01DWAIM.44.86.H09.1.454.CMB.2.raw
  modified_base (365)..(365): a, c, t, g, unknown or other
  modified_base (540)..(540): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggagggaatggagtggattggtgacatcattatacgtggggcgacgtactactctccgtccccctcaagagtccgtctcacctntttcgagggacacgtccatcgaaccgtcttctccctagaaactcgaccctaccgtcgaccgccgcggacacggtctttattcgtgtcgcgaggcgagtactggtactttcaattctagtggggccctggcctaccgttggtcacttgttcttctcacgctccacgttacggcccngttcccg

SEQ ID NO: 363031 - DNA, 553 bp, Homo sapiens
  misc_feature: GZ8MTXP01DE6E7.44.86.H09.1.454.CMB.2.raw
  modified_base (363)..(363): a, c, t, g, unknown or other
  modified_base (504)..(504): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggaggggaatggagtggattggtgacatccattatacgtggggcgacgtactactctccgtcccctcaagagtcgtctcaccngtttcgagggacacgtccatcgaacccgtcttctccctgaaactgaaccctccgtcgaccgccgcggacacggtccgtttatttcgtgtgcgaggcgagactggtctttcaatctagtggggcctggctacccgttggtcncttcgttcttcctcacgtccttcccaccgacgggtcccaagttccccgg

SEQ ID NO: 363032 - DNA, 580 bp, Homo sapiens
  misc_feature: GZ8MTXP01DKIOQ.44.86.H09.1.454.CMB.2.raw
  modified_base (359)..(359): a, c, t, g, unknown or other
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgaggggagggaagtgggagtggagttggtgactatcctattagtacgtggggcgacgtactactctccgtcccctcaagngtcgtctccactnttcgagggacacgtccatcgaaccgcttcgtacctagaaactcgaaccctccgtcgaccggtccgcggaccacggtccgtttattcgtgtggtcgacggcgaagtctggttactttctaatctaggtcggggtccgtggcctacccgttggtccacgttcgttccttcctcacgtccttcccacgaccggtcccttaacgttccccgg

SEQ ID NO: 363033 - DNA, 705 bp, Homo sapiens
  misc_feature: GZ8MTXP01CGWNH.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcacagatgggtcctgtcccaggtgcagctgcaggagtcgggcccaggactggtgaggccttcgggaaccctgtctctcatctgcactgtctctggatttccatcagttctgatcattcttgggctggactccggcacggccccgagggacgggatggagtggagttggtgacatccatttatacgtggggcgacgtactactctccccgtcctcaagcgtcgtctcnctatttcgagggacacgtcatcgaaccgcttctccctagaaacctgaacccttccgtacgacccggtccgacggaccgtaccgggtaccgttttacgtttcgtaggttcggtacccggtagggtccgtaacggttaaccgtttcgggggtttaccttttaacccgttaaagtttcccggttaaaggggttcccggggggtccccggttttacgggggccccgtttaaaccccggttcgggggttcccttaaccgttttccggggttccctttccccgtaccgtaaccgggtacccttttaccccgaaaccccggtaaaaccggggttcccccgtttaaccccggg

SEQ ID NO: 363034 - DNA, 581 bp, Homo sapiens
  misc_feature: GZ8MTXP01BQHFR.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacggcccccgaggggaggggaagtgggagtggagttggtgacatccattatacgtgggcgacgtactactctccgtccccctcaagacgtcgtctcacctgtttcgagggacacgtccagtcgaaccgcttctccctagaaactgacctccgtcgaccgccgcgacacggtctttattcgtgtgcgaggcagtacgtggttactttcaagttctagtcggggtccgtcgggcctacccgttgggtcctacgttcgttccttcctcgacgtcctttacccgacccgaacggggtccccaacgtttccccggg

SEQ ID NO: 363035 - DNA, 556 bp, Homo sapiens
  misc_feature: GZ8MTXP01CJZL8.44.86.H09.1.454.CMB.2.raw
  modified_base (372)..(372): a, c, t, g, unknown or other
  modified_base (452)..(452): a, c, t, g, unknown or other
  modified_base (458)..(458): a, c, t, g, unknown or other
  modified_base (503)..(503): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcttggggctggatccggcacgcccccgaggggaggggaagtggaggtggagttggtgacattccatttatacgtggggacgacgtactactctccgtccccctcagacgtcgtctcacctntttcgagggacacgtccatcgaaacccgtcttctcctagaaactcgaccctcgtcgaccgcgcgacacggtcttattcgngtgcgngcgagctggtcttcaattctagtggggccgtggctaccgttgtcncttcgttcttccgtcacgtccttccgaccgaacgggtcccttaagttccccgg

SEQ ID NO: 363036 - DNA, 591 bp, Homo sapiens
  misc_feature: GZ8MTXP01DZNHY.44.86.H09.1.454.CMB.2.raw
  modified_base (434)..(434): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgccccgagggagggaatggagtggagttggtgacatcctattatacgtgggcgacgttactactctccgtcccctacaagacgtcgtctacactgtttcgagggacacgtccatcgaaccgtcttcctacctagaactcgacctccgtcgaccgccgcgacncgtaccgtttattcgtgtcgcgacggcgagtacttggttacctttcaaattcgtaacggtcgggggtcccgttcgggcctacccgttggtcctacgttcgttccttcccttcacgtccttacccgaccgttaacgggtcccttaacgtttcccccgg

SEQ ID NO: 363037 - DNA, 581 bp, Homo sapiens
  misc_feature: GZ8MTXP01BXIPA.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggacggggaatggagtggattggtgacatccattatacgtggggcgacgttactactctccgtccccctcaagagtcgtctacacctntttcgagggacaccgtcatacgaacccgtcttctccctagaaactgaccctaccgtcgaccgccgcgacacggtcgtttattcgtgtgcgaggcgagacgttggtctttacgattcgtaagtcggggccgtagggcctacccgttgggtcctacgttcgttccttccgtctacgtccttacccgaccgaacgggtccccttaacgtttccccgg

SEQ ID NO: 363038 - DNA, 600 bp, Homo sapiens
  misc_feature: GZ8MTXP01B859U.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtatttccatctagttctgatctattcgttggggctggatccggcacgccccgagggaggggaagtggagtggagttggtgactatctattagtacgtggggcgtacgtacttactcctccgtccccctacagtacgtcgtctcctaccngtttcgacgggacacgtccatacgaaccgtcttcctccctagaaactcgaccctccgtacgaccgccgcggaccgacggtccgtttacttcgtgtgcgaggcgagtctggtccttctaattcgtacggtcggggtccgtggcctacccgttggtacctacgttcgttccttcccgtctacgtcccttcccgacccgttacgggtcccccttaagtttcccccgg

SEQ ID NO: 363039 - DNA, 599 bp, Homo sapiens
  misc_feature: GZ8MTXP01EA330.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacgcccccgagggaggggaatggagtggagttggtgacgatccatttagtacgtggggcgtacgtactactctccgtcccctacagagtcgtctacacctgttcgagggacacgtccatcgaaccgcttctccctgaaactcgacctccgtcgaccgccgacggaccacggtcgtttactttcgtcggttgccggtaaggcgtacgactttgggttacctttcgtaaacttcgttaacgtcgggggtccttgggcctacccgttcggtacgtccttcgttcgttccctctacgtccgttcccacccgacggtaacccgccgttccccgg

SEQ ID NO: 363040 - DNA, 564 bp, Homo sapiens
  misc_feature: GZ8MTXP01ADLP2.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggaggggatggagtggattggtgacatccattatacgtggggcgacgtactactctccgtccccctcagacgtcgtctacaccntttcgagggacacgtcatcgaaccgcttctccctgaaactcgaccctccgtcgacccgccgcggacacggtccgtttattcgtgtcgcgaggcgagacgtggttcttcgaattcgtagtcggggccttgggccacccgttgggtctacttgttccttcctcacgcctttccaccgttaacgggcccaagtttccccggg

SEQ ID NO: 363041 - DNA, 676 bp, Homo sapiens
  misc_feature: GZ8MTXP01DH93Z.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtattccatcagctctgatcattcgtgggctggactcccggcacgcccccgagggagggaatggagtggattggtgacatcctattatacgtggggcacgtactactctccccgtcctacaagtacgtcgtctctaacctatttcgacgggacacgtcatacgaacccgtcttacctccctagtaaacctcgaaccccgttccgtacgaccccggccggaccgggaacctaccgggttcccgttttaaggtttccgttaggttcggaccggtagggccgtaaggtaccgtttgggttccttttacgaaacgtttccgttaagggtccgggggtcccggttcgggtacccgttaacccccggttgggtacccttacgtttcggttcccttcccgttaccgaaccgttcccgttaccccgaaccgtaaaccggggttccccttaacccggg

SEQ ID NO: 363042 - DNA, 596 bp, Homo sapiens
  misc_feature: GZ8MTXP01D9M2A.44.86.H09.1.454.CMB.2.raw
  modified_base (383)..(383): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttggggctggatccggcacggcccccgaggggacggggaagtgggaggtggtagttggtgacagtaccatttatacgtggggcgacgttactactctccgtccccctcaagacgtcgtctaccacctntttcgagggaccacgtccatcgaacccgtcttcctccctagaaacctcgaccctccggtcgaccgcccgcggaccacggtccttttattccgtgtcgcgaggcgagtacgttggtactttcaaattcgtacgtggggcccgtggcctacccgttggtccacttcgttccttccgtcacgtccttccaccgaacgggtcccttaagtttccccg

SEQ ID NO: 363043 - DNA, 558 bp, Homo sapiens
  misc_feature: GZ8MTXP01CSLWF.44.86.H09.1.454.CMB.2.raw
  modified_base (358)..(358): a, c, t, g, unknown or other
  modified_base (529)..(529): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggcaaccctgtctctcatctgcactgtctctggagtttccatcagttctgatcattcttgggctggatccggcagccccccgagggaggggaatggagtggattggtgacatccattatacgtggggcgacgtactactctccccgtcctcagagtcgtctcnccatttcgagggacacgtccatcgaacccgtcttcctccctgaaacctcgacctccgtcgacccgccgcgacacgggtccgtttagttctgttcgcgtaggcgagacttggtctttcaattcgtagtcggggccgttgggccaccgtgggtccacgttcgttcctccctcncgtccttccaccgtaacgggcccctaacg

SEQ ID NO: 363044 - DNA, 579 bp, Homo sapiens
  misc_feature: GZ8MTXP01A0Q7U.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggaggggaagtggagtggattggtgacatccattatacgtggggcgacgtactactctccgtccccctcaagtacgtcgtctacacctntttcgagggacacgtccatcgaacccgtcttctccctagaaactcgaccctcgtcgaccgccgcgacacggtcgtttattcgtgtgcgaggcgagctggttactttcaattcgtagtcggggccgtcggggcctacccgttgggtctacgttcggttccttcctcacgtccttacccgaccgttaaccgggcccttaacgtttccccgg

SEQ ID NO: 363045 - DNA, 565 bp, Homo sapiens
  misc_feature: GZ8MTXP01BXQ85.44.86.H09.1.454.CMB.2.raw
  modified_base (363)..(363): a, c, t, g, unknown or other
  modified_base (533)..(533): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttggggctggatccggcacgccccgagggagggaagtggagtggattggtgacatccattatacgtgggcgacgtactactctccgtcccctcagagtcgtctacactntttcgagggacaccgtccatcgaacccgtcttcctccctagaaactcgaaccctccgtcgacccgccgcggacacggtccgtttatttcgtgtcggcgaggcgagtacgtggttctttctaatcgtagtcggggccgtggctacccgttggtactcttcgttcttcctcngtccttccacgacggcccttaacgttccccgg

SEQ ID NO: 363046 - DNA, 666 bp, Homo sapiens
  misc_feature: GZ8MTXP01D1BIF.44.86.H09.1.454.CMB.2.raw
  modified_base (86)..(86): a, c, t, g, unknown or other
  modified_base (392)..(392): a, c, t, g, unknown or other
tcagacagtatatacacgaccggtgctcgatttagtgctatagacttgggtttggggatgctttctgagagtcaaggacctcctgngcaagaacatgaagcacctgttggtttttcctcctgctggtggcagctcccagatgggtcctgtcccaggtgcagctgcaggagtcgggcccaggactggtgacggccttcgggaaccctgtctctcatctgcacttgtctcgtggtactttccattctagttctgtatctattcgttggggctggactccggcacggcccccgaggggacggggaaagtgggaggtggagtttggtgactatcctattagtacgtggggcgtacgttactactcctccgtccccctcaagtgtcgtctacacctntttacgagggacacgtccagtcgaaccgtcttctccctagaaacctcgaccctaccgcgtaccgccgcgaccgtaccggtccgtttattcgtgtacgtcggacgggtcgacgtacgttcggttacctttactaaacgttccgttaagggtcgggggtcccgtttcgggacctaccccgttcgggtaccctaaccgttcggttcccttcccgtctaaccggttcccttaccccgaaccgttacccgggtaaccccgttaaccggtttcccccggg

SEQ ID NO: 363047 - DNA, 566 bp, Homo sapiens
  misc_feature: GZ8MTXP01EKQ4L.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaatggagtggagtggtgacatccattatacgtgggcgacgtactactctccgtccccctcaagagtcgtctactaccaagtttcgagggaccacgtaccatcgaacccgtcttctaccctagaaactcgacctccgtgacccgccgacgacgacggtccgtttatttccggtagtggcgaggcgaagccgtggttctttctaatccgtagtcgggccgtggcacccgttggtctacttgttcttcctcacgcttccaccgacgggtcccaagttccccgg

SEQ ID NO: 363048 - DNA, 774 bp, Homo sapiens
  misc_feature: GZ8MTXP01AQOBF.44.86.H09.1.454.CMB.2.raw
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcagcatctcctgcagttgggagcggctccaacgaggcgggggctagggtttttgagttggttacaagtcggtaaccagctaaacttccgaaggaaccacgacccccaaatcgacctctaactttaccgactaaccacctagttccggcccctacgacgggggttcccctggacccgtactttccgtacgacgggtcccttacccgaaaacgttccgtcgggaccctaaccccgttccgaaccggtccccttccccgtcgggacccctaacgttccgaaccggttcggggcccttaccccgaagggtccgtagggtacggtaagtcgggaagggtccttaggttaactttaacggtttaacgttccggacctaacggtaacccttaagtcggtaacctaaggtttacgtcgttagggtacggttcggtccgggttttgggggttcggtttccggggacggggaaacggggtaaccccggttaaaggggttccgttaaccccgggtttaacccgtacggggttaacccgaacccgggtaccccggaaacggggtccccttccccgggttcccccccgg

SEQ ID NO: 363049 - DNA, 578 bp, Homo sapiens
  misc_feature: GZ8MTXP01DJZOT.44.86.H09.1.454.CMB.2.raw
  modified_base (355)..(355): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcacgcccccgagggaggggaagtgggagtggagttggtgacatccattatacgtggggcgacgtactactctccgtccccctcaagngtcgtctaccacctgtttcgagggacacgtccatcgaaccgtcttctccctgaaactcgacctccgtcgaccgccgcggaccacggtccgtttacgtttcgtcgtggacgacggcgtagacttggttctttctaatcgtagtcggggccgtggcctacccgttggtcctacttcgttccttacctctacgtccttccaccgacgggtcccaacgtttccccgg

SEQ ID NO: 363050 - DNA, 690 bp, Homo sapiens
  misc_feature: GZ8MTXP01CKVTD.44.86.H09.1.454.CMB.2.raw
  modified_base (354)..(354): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacgccccgagggacgggatggagtggtagtggtgacactcctattagtacgtggggacgacgttactactctccgtcccctanaagtgtcgtctacactgtttacggacggacacgtccacgtcgaacccgtcttacctacccgttacgtaaacctcgtaacccgttcccggtacgaccccggtccggaccggtaaccgtaccgggttacccgtttttaacgtttccggttggttcggaccgggttaacgggcggtaacggtacgttcgggtttactttaccgtaagttccgttacggttcgggggtcccgttcgggcccgtaacccggttgggttaccctacgttccggttaccttcccgtccgtaccgtcccgtttacccgaaccggaaccgggtccccgttaacggtttcccccgg

SEQ ID NO: 363051 - DNA, 588 bp, Homo sapiens
  misc_feature: GZ8MTXP01D1UGO.44.86.H09.1.454.CMB.2.raw
  modified_base (435)..(435): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggacgggagtggagtggagttggtgacatctattatacgtgggcgacgtactactcgtcctcccctacaagacgtcgtctacactcgttcgagggacacgtccatacgaaccgtcttcgtccctagaaactcgacctccgtcgaccgccgcgacncggtctttacgttcgtgtcgcgtaggcgagtacgtcggttactttacgtaacttcgtacggtcgggggtccgttgggccctacccgttggtcctacgttcgttccttccgtcacgtcccttaccacccgaacgggtcccttaagtttccccgg

SEQ ID NO: 363052 - DNA, 661 bp, Homo sapiens
  misc_feature: GZ8MTXP01E3E14.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacggcccccgagggaggggaagtggagtggatggtgacatccattatacgtggggcgacgtactactctccgtccccctcaaagagtccgtctacgacctaatttcgaagggacacggtccaagtcgaaacccgtctttcctacccttagaaaaccttcgaacccttcccggcgaacccggccccggacggacccgtaccggtaccgttttaatttccggtggttggccggagggccgtacgaacgttcgggttcttttacaaagttccgtaaggttcgggggcccgttcggggcctaacccccgttggggtacctccgttcggttccttccccttcacggtcccgtttaccccaaccgttaaaccgggggccccttaacggtttccccggg

SEQ ID NO: 363053 - DNA, 608 bp, Homo sapiens
  misc_feature: GZ8MTXP01DOSA6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgacggtccttcgggaaccctgtctctcatctgcactgtctcgtggtactttccatctagttctgtatctattcgttgggctggactccggcacgccccgaggggacgggaagtggagtggagttggtgacatacctattagtacgtggggacgtacgtactactcctccgtcccctacaagtacgtcgtctaaccactgttcgacggacacgtccatacgaaccgtcttcctacctagaactcgaccctcgtcgaccgccgacgacgtcgtcgtttacttcggtgtcgcgacggcgtacgtacgtggtttccttacgtaagttcgtacggtcgggggtcctacggccgtacccgttggtacctcgttcgttcttcctgtacgtccttaccgaccgttacgggtcccttaacgtttccccgg

SEQ ID NO: 363054 - DNA, 529 bp, Homo sapiens
  misc_feature: GZ8MTXP01AP10V.44.86.H09.1.454.CMB.2.raw
  modified_base (305)..(305): a, c, t, g, unknown or other
  modified_base (344)..(344): a, c, t, g, unknown or other
  modified_base (350)..(350): a, c, t, g, unknown or other
  modified_base (407)..(407): a, c, t, g, unknown or other
  modified_base (505)..(505): a, c, t, g, unknown or other
tcagacagtatatacacgaccggtgctcgatttagtgctatagacttgggttggagagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcacctcaacagacatggcatgcacgtggggccnccaggctcgaggcaagggctgggagtggggtgctattanatggtntgatagggaaataataaatattatgtagattcgtagaggcattcacatctaccaganacaattcgaaagaacacactatatactaggaaatgaaatagcctagagacggaccgaaggaacaacgggctacgttctaacgtacttggttgcgaagngtaagtggggcttggtgaataacg

SEQ ID NO: 363055 - DNA, 579 bp, Homo sapiens
  misc_feature: GZ8MTXP01AME9W.44.86.H09.1.454.CMB.2.raw
  modified_base (371)..(371): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaagtggagtggagttggtgacatccattagtacgtggggcgacgttactactctccgtccccctcagacgtcgtctacacctntttcgacgggacacgtccatcgaaccgcttctccctagaaactcgacctccgtgaccgccgcgacacggtctttattcgtgtgcgaggcgagtactggttctttcaagttctagtcggggtccgtgggcctacccgttgggtcctacgttcgttccttccgtcacggtccttacccgaccgaacgggtccccttaagtttcccccggg

SEQ ID NO: 363056 - DNA, 627 bp, Homo sapiens
  misc_feature: GZ8MTXP01B7AIG.44.86.H09.1.454.CMB.2.raw
  modified_base (488)..(488): a, c, t, g, unknown or other
  modified_base (569)..(569): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctcgtggtagtttccatctagttctgatctattcgttgggctggactccggcacgccccgagggaggggaagtggagtggagttggtagacatacctattagtacgtggggcgtacgtactactctccgtcccctagaagtacgtcgtctacacctaagtttcggaagggacacgtacacgtcgaaacccgtcttcctacccttagaaacctcgtaaccctccgtacgacccgccgaccggtacgtaccggttctttacgttcgnggttgaccggaggtccgagtacgttggttacctttacgaacttcgtacgtcgggggtcccgtgggcctacccgttggtccncgttcggttccttccgtcgacgtccttacccaccggaacgggtcccaagtttccccgg

SEQ ID NO: 363057 - DNA, 565 bp, Homo sapiens
  misc_feature: GZ8MTXP01ESQT8.44.86.H09.1.454.CMB.2.raw
  modified_base (359)..(359): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctggggctggatcgcagccccgagggagggagtggagtggattggtgacatccattatacgtgggggcgacgttactactctccgtccccctcaagagtcgtctcaccntttcgagggacacgtccatcgaaccgcttctccctagaaactcgacctccgtcgaccgccgcggacacggtccgtttatttcgtgttgcgtaggcgagacttggttctttccaatctagtggggccgtggcctacccgttggtctacttggttccttccctcacgtcctttaccgacccgaacgggtccccttaagtttccccggg

SEQ ID NO: 363058 - DNA, 645 bp, Homo sapiens
  misc_feature: GZ8MTXP01B70R8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggcccccgaggggacggggagtgggagtggagttggtgactatccattatacgtggggcgtacgtactactcctccgtccccctacaagtacgtccgtctaccacctgtttccgacgggtaccacgtccagtcgaaacccgtcttcctccctagaaaccgtcgtaccctacccggttaccgacccgtcccggaccgggacctaccgggtcccgttttaacgtttcgtcggtcggccggacgggtcgtacgtacgttggttacctttctaaagttccgtaaggtcggggtccgtcggccgtacccgttggtactccgttcgttccttcctcgtacgtccttacccaccgaacgggtcccttaagttccccgg

SEQ ID NO: 363059 - DNA, 722 bp, Homo sapiens
  misc_feature: GZ8MTXP01EV0ZK.44.86.H09.1.454.CMB.2.raw
  modified_base (200)..(200): a, c, t, g, unknown or other
  modified_base (344)..(344): a, c, t, g, unknown or other
  modified_base (551)..(551): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggacctcaccatggagtttgggctgacctgggttttcctcgttgctcttttaagaggtgtccagtgtcaggtgngctggtggagtcggtgggggaggcggtcggtccgccgtcccgtggggacggtcccgtggacgtactcctccgtgtgtggtcgttcgtggtacttacctacctacaacacgacagtggcatgccacgtcgggtcccgccgacggncctaccggacggacggaaacggggtacggtagggggtaggtggggtcggacgttaaccggtttaattagttaggttagtaggtaaagttaagggtaagttaaattaaatattatagtagtacgttacgttaggtaacgggtacgtacgtaccgaacctactacctacctaacgtaacgaaacctaaacgttaacgaaacgaaaccgnccccgtaaaccgtaaactaacgttaacgttaaaggtaaacgtaagtaaagtaacgtaccgtaggaacggtaaccgggaaccggaacgggaccgaccggtacgtcccaggttccgttacggttaaccgtcggtaacggacgggacggttacggggtaacgttcggggtaacg

SEQ ID NO: 363060 - DNA, 560 bp, Homo sapiens
  misc_feature: GZ8MTXP01E0CN7.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggacggggaatggagtggattggtgacatccattatactgggggcgacgtactactctccgtccccctcagagtcgtctcacctntttcgagggacacgtccatcgaaccgcttctccctgaactgacctccgtcgaccgccgcggacacggccgtttattcgtgttgcgtaggcgagacgtggtctttcaatctagtcggggccgtggcacccgttggtctacgttgttccttccctcacgtcctttcccgaccgaacgggtccccttaacgtttccccgg

SEQ ID NO: 363061 - DNA, 560 bp, Homo sapiens
  misc_feature: GZ8MTXP01BKYA6.44.86.H09.1.454.CMB.2.raw
  modified_base (367)..(367): a, c, t, g, unknown or other
  modified_base (454)..(454): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaagtggagtggagttggtgacatccattatacgtggggcgacgtactactctccgtccccctcagacgtcgtctacaccntttcgagggacacgtccatcgaaccgcttctccctgaacctgaccctcgtcgaccgccgcgacgcgctttattcgtgtgcgaggcgngacgtggttctttcgtaattctagtcggggtccgtggccgtacccgttggtccacttcgttccttcctcacgtcctttccaccgacgggtccccgttgttccccgg

SEQ ID NO: 363062 - DNA, 511 bp, Homo sapiens
  misc_feature: GZ8MTXP01A6BJH.44.86.H09.1.454.CMB.2.raw
  modified_base (305)..(305): a, c, t, g, unknown or other
  modified_base (480)..(480): a, c, t, g, unknown or other
  modified_base (489)..(489): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcacttcaacagacatggcatgcactgggtcccncaggctccaggcaagggctggagtgggtgcacttatatggtatgatggaaaattaataatattatgtagattcgagacgggcatcacatctcagagacaattcgaagaacacactatatactaggaaatgaatacgcctagagagccgaggaccaaggcttgtcttactactggngcgagaagngtgggctggagaattaacgaag

SEQ ID NO: 363063 - DNA, 609 bp, Homo sapiens
  misc_feature: GZ8MTXP01BEVAP.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgcccccgaggggacggggaagtgggagtggagttggtgacatcattatacgtgggcgacgtactactctccgtccccctcaagtacgtcgtctccacctaactttcggaacgggtaccaccgtccacgtcgaaacccgtcttcctcccttagaaacctcgaccctccgtcgacccggccgcggacctcggtcctttagtttccgtgtcgcgaggcgagtacctggttcttcgaagttctaggtcggggcccgttggccgtacccgttggtccacgttcgttccttcccttcgacgtcccttacccgaccaaccggggtcccttaacgttccccgg

SEQ ID NO: 363064 - DNA, 599 bp, Homo sapiens
  misc_feature: GZ8MTXP01DGPBB.44.86.H09.1.454.CMB.2.raw
  modified_base (397)..(397): a, c, t, g, unknown or other
  modified_base (436)..(436): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtccaggtgcagctgcaggagtcgggcccaggacgtggtgaggccttcgggaaccctgtctctcatctgcactgtctctggtattccatcagttctgatctattcgttgggctggatccggcacgccccgagggagggaagtggagtggagttggtagacataccattatacgtgggcgacgtactacgtctccgtcccctacaagcgtacgtctacacctgtttcgaggactacgtcccatcgaaacccncttcctccctagaaacctcgaaccgtccgtcggaacccnccggaccggaccgacgtcccgtttaatttccgtggttcgcgaacgggacgtacgtacgttggttacttacgtaacgttcgtacggtcgggccgtcggcccgtaccgttcgtctcgttcgttccttcctcgactcctacccgacgttaccggtcccttcgtccg

SEQ ID NO: 363065 - DNA, 746 bp, Homo sapiens
  misc_feature: GZ8MTXP01A6J16.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggattccatctagttctgatctattcgtgggctggacgtccggcacgccccgaaggggagggaagtgggagtggagttggagactatcctagttacgtacgtggggacgtaccgttactaccttccgtccgtcccccctacgaagtacgtccgttacctaccgtaacctaagtttaccgggaacgggaccctaaccgggttaccaacgttaccggtaaacccgttcctttacccgttaccccgtaaacgggtaaaacccttccggtaaccccgttaccccgggttaaccggaaccccgggtccccgggaccgggtaccgtaacccggggtttcccgttttttaacgttccggggttacggtcggtaccgggacggacggtacgtacgtttcggttaccttttacgaaacgttcgtacggttcggggaaccgttcgggacctacccgttgggtacctacgttcgttcccttccgtcgtacgtcccttccgaccgttacgggtcccttaacggtttccccgg

SEQ ID NO: 363066 - DNA, 566 bp, Homo sapiens
  misc_feature: GZ8MTXP01EBLRM.44.86.H09.1.454.CMB.2.raw
  modified_base (469)..(469): a, c, t, g, unknown or other
  modified_base (484)..(484): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgatctattcgttgggctggatccggcacgccccgaggggagggaagtggaggtggagttggtgacagtccattagtacgttggggcgtacgtactactctccgtcccctcgaagacgtcgtctacacctgtttcgaagggcacgtccatgaaaccgtcttctccctagaaacttcgacctcgtcgaccgcgacgacacggtctttattcggtgtcgcgacgngagactggttccttnaagtctagcggggctggcacccgttggctcgttcgttcttccgtcatccttccgaaccttacgggtcccttaagttccccgg

SEQ ID NO: 363067 - DNA, 559 bp, Homo sapiens
  misc_feature: GZ8MTXP01C9AMB.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggatggagtggattggtgacatcattatacgtggggcgacgtactactctccgtcccctcaagagtcgtctcaccngtttcgagggacacgtccatcgaaccgtcttctcctgaaactcgacctccgtgaccgccgcgacacggtccgtttagtttcgtgtgcgacgcgagacgttggtctttcaatcgtagtcggggccgttgggctacccgttggtacctcttcgttccttcctcacgtccttcccaccgacgggtcccaacgtttccccgg

SEQ ID NO: 363068 - DNA, 582 bp, Homo sapiens
  misc_feature: GZ8MTXP01BEOAW.44.86.H09.1.454.CMB.2.raw
  modified_base (533)..(533): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctccagatgggtcctgtcccaggtgcagctgcaggagtcgggcccaggactggtgaggccttcgggaaccctgtctctcatctgcactgtctctggtatttccatcagttctgtatctattcgttggggctggactccggcacgcccccgaggggagggaagtggaggtggagttggtggacagtacctagttatacgtaggggcgacgttactactcctccgtcccctcaagtagtcgtctacactctttcgacgggacacgtccagtcgaaccgtccttactccctacgaaactcgacctccgtcgacccgccgacgacaccggtctttattcgtgtcgtcgacggcagtacgtcggtcttctaatcgtacgtggggccgtggaccctccgttggtccncttcgttccttctcacgtccttccaccgaacggtcccaacgttccccgg

SEQ ID NO: 363069 - DNA, 588 bp, Homo sapiens
  misc_feature: GZ8MTXP01EQOUA.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgatctattcgttggggctggactccgggcgacgggcccccgggggaggggaacgtgggagtggagttgggtgactatccaattagtacgtggggcacgtactactctccgtcctcaagtagtcgtctcaacctattcgaggacacgtccagtcgaaccgtcttctcctagaaactcgacctcgtcgaccgtccgcgacgaccggtccgtttattcgtggtgcggtagacgtagtacgtggttctttacaatcgtaggtcgggcgtggccttaccgtggttccacgtcgttccttccttcgtaacgccttccgaccgtaacggccctaacgttccgttccccg

SEQ ID NO: 363070 - DNA, 590 bp, Homo sapiens
  misc_feature: GZ8MTXP01DORKX.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatctagttctgatctattcgttgggctggactccggcacgccccgagggagggagtggagtggagttggtgacatactattatacgtgggcgtacgtactactctccgtcccctacaagtacgtcgtctacacctgtttcgaggacacgtccactcgaacccgtcttctcctagaactcgacctccgtcgaccgccgacgactacggtcgtttattcgtgtcgcggtacgcgacgtacgttcggttacttctaattctacggtcggggtccgtcggacccgtcccgttggtaccacttcgttcttccctcacgtccgttacccaccggttaaccggtcccttaacgttccccgg

SEQ ID NO: 363071 - DNA, 678 bp, Homo sapiens
  misc_feature: GZ8MTXP01AKO0M.44.86.H09.1.454.CMB.2.raw
  modified_base (308)..(308): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtccctgagctctcctgtgtagcgtctggattcaccttcaacagacatggcatgcacgtcgggtcccncaggcctccgaggcgaagggactgggaggtgggtcgctacttatatggtatggaataggaaaagttaaattaaagtatttaagtaggttaagtacgtttaccgggtaggaaacggggtccctaatttacccaacctacttacctacccgaaagggaacgtaacctaaagtttaccgaaaacgtaaacctaacctaacttaaatacgttaacgttaagggaaaattaggaaattaacggacctaggaagtaccggacccggaacgggaccgtaaccgggtcttacgggttaccttaaccgttacgtggttacgggcgaaagggaaggtacgggtgggggacccgttcgggttacggtaagttaaccgaagg

SEQ ID NO: 363072 - DNA, 592 bp, Homo sapiens
  misc_feature: GZ8MTXP01BJLYP.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgacggccttcgggaaccctgtctctcatctgcactgtctctggtatttccatcagttctgatctattcgttggggctggatccggcacgccccgagggagggaagtggagtggagttggtgactatcctattagtacgtggggcgtacgtactactctccgtcccctacaagagtcgtctacacctgttcgagggacacgtccagtcgaacccgtcttctccctagaaacctcgaccctccgtcgaccgccgcgactcggtctttagttcgtgtgcgaggcgagacgttggttccttctaagttctaggtcggggtcccgtcggcctaccccgttggtcctacgttcgttccttccctcgacgtccttacccgaccgaaccgggtccccttaacgtttcccccgg

SEQ ID NO: 363073 - DNA, 531 bp, Homo sapiens
  misc_feature: GZ8MTXP01BC3MO.44.86.H09.1.454.CMB.2.raw
  modified_base (279)..(279): a, c, t, g, unknown or other
  modified_base (360)..(360): a, c, t, g, unknown or other
  modified_base (410)..(410): a, c, t, g, unknown or other
  modified_base (421)..(421): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatcggcagcccccagggngggaatggagtggattggtgacatccattatactgggggcgacgtactactctccgtccccctcaagagtcgtctacaccntttcgagggacacgtccatgaaccgcttctccctgaaactgacctccgtnaccgcgcgacncgcgtttatcgtgtgcgagcgagacctggtcttctaatctatggggccgttggcacccttggtcacttgttcttcctcacgtcttccaccaacgggtcccaagttcccgg

SEQ ID NO: 363074 - DNA, 569 bp, Homo sapiens
  misc_feature: GZ8MTXP01ES3XV.44.86.H09.1.454.CMB.2.raw
  modified_base (465)..(465): a, c, t, g, unknown or other
  modified_base (469)..(469): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgtatctattcgttggggctggactccggcacggccccgaggggacggggaagtgggagtggagttggtgactatccatttagtacgtggggcgacgttactactcctccgtcccctcaagcgtcgtctacacctgtttcgagggacacgtcatcgaaccgtcttctccctagaactcgacctccgtcgaccgccgcgacacggtcgtttattcgtgtgcgngcgngtcgttggtcttcattcgtagtcggggcctggcctaccgttggtctcttcgttcttcctcacgtccttaccgaccgaacgggtcccttaacgttccccgg

SEQ ID NO: 363075 - DNA, 612 bp, Homo sapiens
  misc_feature: GZ8MTXP01D4UEA.44.86.H09.1.454.CMB.2.raw
  modified_base (468)..(468): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcagggagtcgggcccaggactggtgaggccttcgggaaccctgtctctcatctgcactgtctcgtggtagtttccatctagttctgtatctatttcgttggggctggatccggcacggcccccgaggggacggggaagtggaggtggagttggtgacatccattagtacgtgggggcgtacgtactactcctccgtccccctcaagagtcgtctaccacctaagtttcgaagggaccacgtccatcgaacccgtcttcctccctagaaacctcgacccttcccgtcgacccgtccgacggaccncggtaccgtttacttcgtagttgcgaggcgagacttggtctttacacttgtacgtcgggggccgttggcctacccgttgggtcctacttcgttccttcctcacgtccttacccgacgttaccggtcccgttaacgttccccggg

SEQ ID NO: 363076 - DNA, 547 bp, Homo sapiens
  misc_feature: GZ8MTXP01DSA6K.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggagttggtgacatccattatacgtggggcgacgtactactctccgtccccctcaagagtcgtctacacctaagtttcgagggacacgtccatcgaaccgcttctccctagaaactgaaccctccgtcgaccgccgcgacacgaccgtttattcgtagtgcgaggcgagactggtctttcaattctagtggggcctggccacccgttggtcacttgttccttctcagccttccacgacggtcccaagtccccgg

SEQ ID NO: 363077 - DNA, 610 bp, Homo sapiens
  misc_feature: GZ8MTXP01EMFG0.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgagggacggggaagtggagtggagttggtgacatccattatacgtggggcgtacgtactactctccgtcccctcaagagtcgtctacactntttcgagggcacgtccatcgaaacccgtcttactccctagaaactcgaacccttccgtcgacccgccgacggacacggtccgtttattcgtgtgcgaggcgacgacttggttactttcaagttcgtacggtcgggggtcccgtggcccgtacccgttgggtacctaacgttcggttccttccgttaacgacggtccctttaccgacccgttaaacgggtccccttaacgtttcccccggg

SEQ ID NO: 363078 - DNA, 608 bp, Homo sapiens
  misc_feature: GZ8MTXP01ERUTX.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatctattcgttggggctggactccggcacggcccccgaggggaggggaagtgggaggtggagtttggtggacatcctattagtacgtgggcgacgttactactctccgtcccctcaagacgtcgtcctaccacctaagtttcgaaggggacaccgtaccatcgaaacccgtcttcctaccctagaactcgaccctcgtcgaccgccgacgacacggtccgtttacgttcgtggttcgacgacgggcgagtacgttggttccgtttactaacgttcgttagtcgggggcctcgggcctacccgttggtcctacgttgttccttcctcgacgtccttccgaccacgggtcccttaacgttccccg

SEQ ID NO: 363079 - DNA, 607 bp, Homo sapiens
  misc_feature: GZ8MTXP01ANKU6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacggcccccgaggggacggggaagtgggagtggattggtgacatcctattagtacgtgggggaccgtacgttacctactctccgtccccctcaagtacgtcgtctacacctgtttcggaacgggacaccgtccagtcgaaacccgtcttcctaccctagaaacctcgaccctccgtcgaccgccgcggacacggtcctttattcgtgtgcgaggcgtagcgtggttcttccaattcgtagtcggggccgtcggcctacccgttggtcctacgttcggttccttcccgtcacgtcccttacccaccggttaaccgggtcccttaacgtttccccggg

SEQ ID NO: 363080 - DNA, 581 bp, Homo sapiens
  misc_feature: GZ8MTXP01CI0HO.44.86.H09.1.454.CMB.2.raw
  modified_base (352)..(352): a, c, t, g, unknown or other
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtgacatccattatacgtggggacgacgttactactctccgtccccctnagagtcgtctccacctntttcgagggacacgtccatcgaaaccgcttctccctagaaactcgtaccgtccgtacgacccgccgcggactacggccgttttaattcgtgtggcgaggccgagacctggtcttcaatctagtcggggcgtcggctacccgttggtcctacttcgttccttaccttcacgtcctttccgacccgttaacggggtccccttaagttccccggg

SEQ ID NO: 363081 - DNA, 670 bp, Homo sapiens
  misc_feature: GZ8MTXP01DEL9Q.44.86.H09.1.454.CMB.2.raw
  modified_base (271)..(271): a, c, t, g, unknown or other
  modified_base (315)..(315): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggaggcgtggtccagccgtgggacgtccctgagactctcctgtgtagcgtntggattcaccttacaacagacagtggcatgcacgtcgggtcccncaggcctccgaggacgaaggggcttggggaggttggggtacgactacgtttaatagttagggttaaatttagtaaggggaaaatttaaaaattaaaagttgtttaaacgttaggtaaacgtaagtttccccgggtaggaaacgggggtccctaatttaccgaacccgtaactcctacccgaagaacgtaaaccgtaaattaccggaaaataaaccaactaactaattatacgtaaggtaaatagaaattacgcgtaggaagacgccggaaggaccgacggctcgttactacttacgttggtcgacggttaggaggtaacggtggggtccttacgggtaggaactaacgaaggtaa

SEQ ID NO: 363082 - DNA, 599 bp, Homo sapiens
  misc_feature: GZ8MTXP01CBZWV.44.86.H09.1.454.CMB.2.raw
  modified_base (355)..(355): a, c, t, g, unknown or other
  modified_base (590)..(590): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggtctggactccggcacgccccgaggggacgggagtggagtggagttggtgactatcctattatacgtggggcgacgtactactctccgtcccctnagagtcgtctacactgttcgagggactacgtcatcgaaccgtcttcctcctagtaaactcgaaccctccggtcgaccgcccggacggaccgacggttccgtttatttcggtaggttcggcggacgggcgtaacgtcgttcggttcctttacgtaattcgtacggtcggggtccgtggccctaccgttggtacctcgttcgttccttcctcacgtccttccgaccgacgggtcccngttccccgg

SEQ ID NO: 363083 - DNA, 652 bp, Homo sapiens
  misc_feature: GZ8MTXP01AQW82.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgttggggctggatccggcacgcccccgagggacggggaatgggagtggagtggtgacatcctattagtacgtgggcgacgtactactctccgtcccctcagtagtcgtctacacctgtttcgagggactacgtacagtacgaaccgtccttactcccgtagtaaacctcgacccgtacccgtcgacccgcccgccggacctaccgggttaccgtttactttcggtcgttcggccggacgggtccgtagaccgtttcgggttcctttacgtaacgttcgtaacggtcgggggtcccgttcgggcccgtaaccccgttcgggtaccctacgttcggttcccttcccgtcgtaccgtccttacccgacccgaaccggggtccccttaacgtttcccccggg

SEQ ID NO: 363084 - DNA, 697 bp, Homo sapiens
  misc_feature: GZ8MTXP01CXJVT.44.86.H09.1.454.CMB.2.raw
  modified_base (381)..(381): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggagtttccatcagttctgatcattcgttggggctggactccggcacgcccccgaggggagggaagtgggagtggagttggtagactatccaagtttacgtacgttgggggacgtacgtactactctccgtaccccctcaagagtcgtctcacctntttcgagggacacgtcactcgaacccgtcttcctcctagaaacctcgtaccctaccggtacgacccgccggaccggtaccgacccgggttccgttttaacgtttcggtcggttcggaccggtacgggaccggtaacgtaccgttcggggtttaccttttacgtaaacgttccggttaacgggtccgggggtcccggttcgggcccgttaacccgttcggggttcctaaccgttcgggttcccttcccggttctaacccggttcctttaccccgtaacccggaaaccggggtccccttaaccggttttcccccgggg

SEQ ID NO: 363085 - DNA, 530 bp, Homo sapiens
  misc_feature: GZ8MTXP01ARMY6.44.86.H09.1.454.CMB.2.raw
  modified_base (306)..(306): a, c, t, g, unknown or other
  modified_base (376)..(376): a, c, t, g, unknown or other
  modified_base (380)..(380): a, c, t, g, unknown or other
  modified_base (484)..(484): a, c, t, g, unknown or other
  modified_base (500)..(500): a, c, t, g, unknown or other
  modified_base (506)..(506): a, c, t, g, unknown or other
  modified_base (508)..(508): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctggggacgtccctgagctctcctgtgtagcgtctggattcaccttcaacagacatggcatgcacgtgggtccncaggcctccgaggcaagggctggggacgtggggtgctacgttatagtggtatgataggaaaataataatnttangtagattcgagaacgggcctattcacatctaccagacgacaattacgaaagaacacactataatcgtaaggaaatagaatcgactagagagaccgaggcaacgnttgtcttactactggngcgagngngtgggctggttggaattcgaag

SEQ ID NO: 363086 - DNA, 665 bp, Homo sapiens
  misc_feature: GZ8MTXP01EZJCC.44.86.H09.1.454.CMB.2.raw
  modified_base (383)..(383): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggatttccatcagttctgatctattcgttggggctggactccggcacggcccccgaggggaggggagtgggaggtggtagttggtgacactcctattacgtacgttgggggcgtacgtactactcctccgtccccctacagacgtccgtctacacctntttcggagggaccacgtcactcgaacccgtccttcctccctacgaaacctcgaccctcccgaacgacccgcccggccggaccgtaaccgggtcccgtttacgttccggttacgtcggtccggacgggccggtacggtaccgttcgggttacctttaccgtaagttccgtaacgggttcgggggtcccggtcggttcccgtacccgttcggtcctgaacccttcggttcctcccgtcctaaccgccgtttacccggacccctaaaggggttcccccgtaaccc

SEQ ID NO: 363087 - DNA, 562 bp, Homo sapiens
  misc_feature: GZ8MTXP01AD03E.44.86.H09.1.454.CMB.2.raw
  modified_base (366)..(366): a, c, t, g, unknown or other
  modified_base (433)..(433): a, c, t, g, unknown or other
  modified_base (459)..(459): a, c, t, g, unknown or other
  modified_base (471)..(471): a, c, t, g, unknown or other
  modified_base (503)..(503): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcacgcccccgaggggaggggaagtggagtggagttggtgacatccattagtacgtggggcgacgtactactctccgtcccctcagagtcgtctcacctntttcgagggacacgtcatcgaacccgtcttctcctagaaactcgaccctccgtcgaccgccgcgacncggtcgtttattcgtgtgcgaggcgngacgtggtcttntaatctagtcggggcctggccaccgttggtcncgttcgttccttccttccacgtccttcccgaacccgaacgggtcccaacgtttccccgg

SEQ ID NO: 363088 - DNA, 761 bp, Homo sapiens
  misc_feature: GZ8MTXP01AR8VD.44.86.H09.1.454.CMB.2.raw
  modified_base (309)..(309): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagcctgggagtccctgagctctcctgtgtagcgtctggattcaccttcaaacagacagtggcatgcacgtcgggtcccnccagggcctaccgaggccgaaagggggtactgggacggtgggtcggcctaacgtttagtacgtgggtataggaatagggtaaaaaagttaaattaaagttatttaaacgtaggttaacgtacgtttacccgggagggtaaacggggtacccgtaagtttaccaacccgtacttacccgttacccgaaagggtaacgtaaaccgtaaacgtttaccggaaaacgtaaacctaaccgttaaacttaaagttaacgttaacggtaaagggtaaaacttaaggtaaaacttaaccggacccgttaaagggaacggtaaccgggaacccggtaaacggggaaccgtaaccggggtaccttacgggttacccttaacgttaccgtgggttacggacgggaaggtaagggtagggttccgggggtacgttacgggttagggtaacgttaacggtaaagg

SEQ ID NO: 363089 - DNA, 619 bp, Homo sapiens
  misc_feature: GZ8MTXP01CFMBN.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagttccatctagttctgatctattcgttgggctggatccggcacgccccgagggacgggaagtggagtggagttggtgacatcctattagtacgtgggacgtacgtactactctccgtccccctacgagacgtcgtctacacctcgttcgacgggactacgtccacgtcgaaacccgtcttacctccctagaacctcgaccctccgtacgacccgccggaccgtaccgacggtccgtttactttcggtgtcgcggtacggcgtaacgtcgttacggttactttcgtaacgttcgttacggtcggggtccggtcggcccacccggttgggtcctcgttcgttccttccttcacgtccttcccgaccgaacgggtcccttaacgttccccgg

SEQ ID NO: 363090 - DNA, 600 bp, Homo sapiens
  misc_feature: GZ8MTXP01B0EZL.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatgggagtggagttggtagacgatccattatacgtgggggcgacgtactactctccgtccccctcaagagtccgtctaccacctgtttcgagggacacgtccatcgaacccgtcttctccctagaacttcgaccttcccgtcgaccgccgcggaccacggtccgtttatttccgtgtgtccgaggcgacgacgtggttctttctaagttcgtagtcgggggccgttcggcgtccccgttggttccgcgttcgttcgttccccttcacgtcccttcccgaccgttaacggggcccccttaacgtttccccggg

SEQ ID NO: 363091 - DNA, 591 bp, Homo sapiens
  misc_feature: GZ8MTXP01BFOGX.44.86.H09.1.454.CMB.2.raw
  modified_base (559)..(559): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacggcccccgaggggacgggaagtgggaggtggagttggtgacatcctattagtacgtggggtcgacgttactactcctccgtccccctacgacgtacgtcgtctacacctgttcgaacgggaccacgtaccactacgaaccctcgttcctccctagaacctcgacctccgtcgaccgccgacgacaccggtctttacgttcgtgttcgcgaggcgagtacgttggttaccttcgtaagtctacggtcggggtcgtcggctcccgttggtcacttcgttcttcctcncgtcttcccgaccgacggtcccttgttccccg

SEQ ID NO: 363092 - DNA, 578 bp, Homo sapiens
  misc_feature: GZ8MTXP01AI1ZH.44.86.H09.1.454.CMB.2.raw
  modified_base (353)..(353): a, c, t, g, unknown or other
  modified_base (529)..(529): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggactccggcacgcccccgagggaggggaatgggagtggattggtgactatccattatacgtgggggcgacgttactactctccgtccccctnaacgagtcgtctccacctgtttcgagggacacggtccatcgaaacccgtcttactccctagaaacctcgaccctccgtcgacccgccgcggacctacggtccttttattcgtggtcgcgaggcgagtctggttctttactaattcgtagtcggggccgtggcctaccgttggtccncttgttcccttctcacgtccttcccaccgacgggtcccaagttccccgg

SEQ ID NO: 363093 - DNA, 572 bp, Homo sapiens
  misc_feature: GZ8MTXP01CG660.44.86.H09.1.454.CMB.2.raw
  modified_base (164)..(164): a, c, t, g, unknown or other
  modified_base (278)..(278): a, c, t, g, unknown or other
  modified_base (306)..(306): a, c, t, g, unknown or other
  modified_base (458)..(458): a, c, t, g, unknown or other
  modified_base (546)..(546): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttccncgttgctcttttaagaggtgtccagtgtcaggtgaagctggtggagtcgtgggggagcgtggtccagcctgggagtccctgagactctcctgtgtagcgtctggattcaccttnaacagacatggcatgcacgtgggtcccncaggctccgaggcaaggggctgggagtgggtggctacgtttatagtgggtatggatagggaaaaagttaataatatttaagtgttaagatttccgggtagaaacggggtcccgtattccaccgatcctacccaagacgaacaattacggaanaacacaactagtatacgtaggaaatagaaatagacctaggagaggccgaggacaacggcttgtccttacgtacgtgttcgcgagaagngtggggctcggttaggtaattcgaag

SEQ ID NO: 363094 - DNA, 698 bp, Homo sapiens
  misc_feature: GZ8MTXP01BO611.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggatttccatcagttctgatcattcgttggggctggatccgggcacggcccccgaggggacggggaatgggagtggattggtgacatccattatacgtggggcgtacgtactactctccgtccccctcaagagtcgtcctacacctgtttcgacgggtacacgtccagtcgaaacccgtcttacctcccttagaaacctcgaacccgtccgtacgacccgccgaccggacaccgggttaccgttttagtttcgtggttcgcggtacgggcgacgtaccgttgggttaccttttacgtaaacgtttccgttaacggttcggggggtaaccccgttcgggttacccgtaaccccgttcggggttaccctaaccgtttccgggttccctttccccgttccctaacgggtccccttttaaccccggaaccccggttaaacccgggggtcccccttaacggttttcccccccgggg

SEQ ID NO: 363095 - DNA, 629 bp, Homo sapiens
  misc_feature: GZ8MTXP01EI804.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaacctgtctctcatctgctactgtctcgtggtacgtttccattctagttctgtactctattcgttggggctggactccggcacgccccgaggggagggaagtggagtggagttggtagactatacctaagtttacgtacgtggggaccgtacgttaccttacgtcctcccgtcccctacaagtacgtccgtctaacacctgttcgaacgggtactacgtcctatcgaacccgtcttacctacctagaaacctcgaccctcgtcgaccgccgacgactacggtacgtttattcggtgtggtcgaggcgtagtacgttggttacttttacaaacttccgttaggtcgggggtccttaggccctacccgttggtccacgttcgttccttcctcgacgtccttaccgaccgttacggtcccttaacgttccccg

SEQ ID NO: 363096 - DNA, 583 bp, Homo sapiens
  misc_feature: GZ8MTXP01EUQWB.44.86.H09.1.454.CMB.2.raw
  modified_base (350)..(350): a, c, t, g, unknown or other
  modified_base (393)..(393): a, c, t, g, unknown or other
  modified_base (480)..(480): a, c, t, g, unknown or other
  modified_base (543)..(543): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgtgggctggactccggcacgccccgagggagggaatggaggtggattggtgacatactattagtacgtgggacgacgtactactctccgtcccctnaagtacgtcgtctacacctgttcgagggacacgtcatcgaccncttcacctagaaactcgaccctcgtcgaccgccgacggactcggtcgtttattcggtgtcggcgaggcgtagtacgttgttaccttntaacgttcgtaggcggggtcctcggcctaccgttggtacctacgttcgttcccttccgtaacncgtccttacccgacgttaccggtcccttaacgttccccgg

SEQ ID NO: 363097 - DNA, 593 bp, Homo sapiens
  misc_feature: GZ8MTXP01CR9P8.44.86.H09.1.454.CMB.2.raw
  modified_base (355)..(355): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttggggctggatccggcacgccccgagggacggggaagtggagtggagttggtgacatccattatacgtgggggcgacgtactactctccgtccccctacagngtcgtctcacctgtttcgagggacacgtccatcgaaccgcttctcctagaaactcgacctccgtcgaccgccgcggactacgggtccgtttattcgtgtcgcgaggcgtagccgttggttcctttcgtaaactcgtagtcgggggcccgttgggcctaccccgttggtaccctcgttcggttccttcccgttcacgtcctttcccgaccgaacggggtccccttaacggtttccccgg

SEQ ID NO: 363098 - DNA, 599 bp, Homo sapiens
  misc_feature: GZ8MTXP01DMHCW.44.86.H09.1.454.CMB.2.raw
  modified_base (437)..(437): a, c, t, g, unknown or other
tcagacagtatatacacgaccggtgctcgatttagtgctatagacttgggtttgggcacaagaggcagcactcaggacaatctccagcatagcctggtctcctctcctcctcactctcctcgctcactgcacagggtcctgggcccagtctgtgctgacgcagcccgccctcagtgtctggggccccagggcagagggtcagcatctcctgcagttgggagcggctccaacgaggcggggctaggttttgattgttcaagtcggtaccagcaaacttccgaaggaaccacgacccccaaatcgctactatttacgactaacacctagttccggccctcgacgggtccctgaccgtacttcctacgacggtcctaccgaaagtctcggacctaccgtcacgtcccctccgtggcccatcacgtcggctcgagctgagntgagtctagtattagtacgtgacctagacctagtcgactagtgtcgtggtagttggtcggtttggggttcggttcggggacgggtacggggaaccgttaggggttccgttaccggtcggtacggtccgacggacccgaacgggtcccgttcccggtcccccg

SEQ ID NO: 363099 - DNA, 628 bp, Homo sapiens
  misc_feature: GZ8MTXP01EUQ7W.44.86.H09.1.454.CMB.2.raw
  modified_base (586)..(586): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaacctgtctctcatctgcactgtctctggattccatcagttctgatctattcgttggggctggactccggcacggcccccgaggggacggggaagtgggagtggtagttggtgactatcctattatacgtggggacgtacgtactactcctccgtccccctacaagacgtcgtcctaccaccgtgtttcgaacgggacctaccgtccaatcgtaaacccgtcttcctaccctagaaacctcgaccctccgtcgaccgccgcgaccgtacggtccgtttacttcggtgttcgcgaggcgagtacgttggttacttctaagttcgtacgggtcggggcccgttacgggttcctacccgttgggtacctcgttcgttcccttccgttccncgtccttacccgaccgttaacggcccgttaacgtttccccgg

SEQ ID NO: 363100 - DNA, 706 bp, Homo sapiens
  misc_feature: GZ8MTXP01AE9C2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgctactgtctcgtggtacgtttccatctagttctgatctattcgttgggctggactccggcacgccccgaggggagggagtggagtggagttggagacatcctattacgtacgtcggggacgtacgtactactcttccgtcccctacacgtacgtcgtctaccacctgtttacggacgggtacacgtaccagtacgaacccgtcttcctaccctacgtaaccgtcgtaacccgtccggtccgacccggcccggaccggtaccgtaccgggttaccgttttacgtttccggtaggttcggccggtacggggtacgtaacggtcgttcgggtttacctttacgtaacgttccgttacgggtcgggggtaacccggtcggttacccggtaccccgttgggttcccgtacgtttccggttcccttcccgtccgtacggttccccgttaccccgaaccggttaacccgggtccccgttaaccggtttcccccggg

SEQ ID NO: 363101 - DNA, 671 bp, Homo sapiens
  misc_feature: GZ8MTXP01DMRUZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgccccgagggagggatggaggtggtagttggtgactatctattagtacgtggggcgtacgtacgtactctccgtcccctcaagagtcgtctaacacctaagtttcggaagggacacgtaccatacgaacccgtcttctaccctagaaactcgaccctccggtacgacccgccgaccggaccgtaaccggttccgtttactttcggtacgtcgtacggaacgggtcgacggtacgttcgggttctttacgtaaacgttcgtacggttcgggggcccgttcgggcccgtaacccggttcggttaaccgtccgttcggttcccttaccccgttccgtaaaccggttccctttacccgaacccggttaaaccggggtccccttaacggttttcccccgggg

SEQ ID NO: 363102 - DNA, 557 bp, Homo sapiens
  misc_feature: GZ8MTXP01C66C4.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccagggacggggaagtggagtggattggtgacatccattatacgtggggcgacgtactactctccgtccccctcaagagtcgtctccaccntttcgagggacacgtccatcgaacccgcttctccctagaaactgaccctcgtcgaccgccgcggacacggtccgtttagtttcgtgtgcgacggcgagacgtgggttctttcaattcgtagtggggccgtggcctacccgttggtccacttcgttcttcctcagtcttccacgaacgggcccaagttccccgg

SEQ ID NO: 363103 - DNA, 554 bp, Homo sapiens
  misc_feature: GZ8MTXP01AZWZ8.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaagtggagtggattggtgacagtccattatacgtggggcgacgtactactctccgtccccctacagagtcgtctacacctnttcgagggtacacgtcatcgaaccgcttctccctagaaactcgacctccgtcgaccgccgcggacacggtccgtttattcgtgtgcgaggcgagactggtctttcaatctagcggggcctgggcctacccttggtccacgttgttccttcctcagtccttcccaccgacgggccccaagttccccgg

SEQ ID NO: 363104 - DNA, 597 bp, Homo sapiens
  misc_feature: GZ8MTXP01EW33R.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacggcccccgaggggacggggaagtggagtggagttggtgacatcctattatacgtggggcgtacgtactactctccgtccccctcaagagtcgtctacacctgtttcgagggaccacgtccagtcgaacccgtcttctccctagaaactcgaccctaccgtcgacccgccgacgacgtaccggtccgtttattcgtgttgcggaggcgtagtaccgttggttactttacgtatcgtagtcggggcgtcggcctacccgttggctacgttcgttcccttacctctacgtccttcccgacccgacggtcccgttaacgttccccggg

SEQ ID NO: 363105 - DNA, 609 bp, Homo sapiens
  misc_feature: GZ8MTXP01EOCK8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgtatctatttcgttggggctggactccggcacggccccgaggggagggaagtggagtggagttggtgacatcctagttatacgtggggcgacgtactacgtctccgtcccctacgagacgtcgtctaccacctgtttcggacgggactacgtcacgtcgaaccgtcttctacctacgaactcgacctccgtacgaccgccgacggacctacggtaccgtttacgttcgtggtcggcggacggcgtaacgtcgttggttcctttcaaacgttcgtacggtgggggtcccgtcggcctacccgttgtaccgtcttcgttcttccttcacgtccctacgaccgttacgcccgttaacgttccccg

SEQ ID NO: 363106 - DNA, 531 bp, Homo sapiens
  misc_feature: GZ8MTXP01ESXYD.44.86.H09.1.454.CMB.2.raw
  modified_base (309)..(309): a, c, t, g, unknown or other
  modified_base (368)..(368): a, c, t, g, unknown or other
  modified_base (372)..(372): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtggggacgtccctgagactctcctgtgtagcgtctggattcaccttcaacagacatggcatgcacgtgggccncaggctccaggcaagggctggagtgggtgcattatatggtatgatggaaaataataatnttangtagattcggagacgggcattcacatctcagagacaatacgaagaacacactagtatactaggaaatagaaatgcctaggagagaccggaaggacgaacggtcttgtcttacgtacgtgttgcgaggaagagtggggctggttaggtaacttaacgaag

SEQ ID NO: 363107 - DNA, 555 bp, Homo sapiens
  misc_feature: GZ8MTXP01DGI7Z.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtacgtactctccgtccccctcaagagtcgtctcacctntttcgagggacacgtccatcgaacccgcttctccctagaaactcgacctccgtcgaccgccgcgacacgccgtttattcgtgttgcgaggcgacgtactggttcctttcaatcctagtcggggccgttggctacccttggtccacttcgttcttcctcacgtcttccacaacgggtcccaagttccccgg

SEQ ID NO: 363108 - DNA, 636 bp, Homo sapiens
  misc_feature: GZ8MTXP01AVIL9.44.86.H09.1.454.CMB.2.raw
  modified_base (578)..(578): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgctactgtctctggtatttccatctagttctgatctattcgttggggctggactccggcacggcccccgaggggacggggaagtgggaggtggtagttgggtgacatccatttatacgtgggggacgtacggtactactctccgtccccctcaagtacgtcgtctaccacctaatttcggacgggacacgtccatcggaaacctcttctcctagaacctcgaccctccgtcgaccgccgacgacgtcggtcgtttacttcgtgtgtcggaggcgtaagtcgttcggttctttacgacgttactaggtcgggggtccgtcggccctacccgttgggttaccctacgttcggttcccttcccgttnaccggtccctttccgaaacccggttaacccggggtccccttaacggtttcccccgggg

SEQ ID NO: 363109 - DNA, 681 bp, Homo sapiens
  misc_feature: GZ8MTXP01CNRCY.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtacgtttccattctagttctgatctattcgttgggctggatccggcacgccccgagggacgggagtggagtggagttggtgactatccattagtacgtggggactacgtactactctccgtcccctacaagtcgtccgtctaacctaacctaagtttccggaacgggactacggtcctaagtcgaaacccgtcttaccgtacccttagaaaccgtcgaacccgttccgtacgacccggccggcggtaccgtcggttaccgttttactttcggtgttcggacggtacgggtaccgtaagtaccgttgggttacctttacgtaacgttcgtaacggtcgggggtaacccgttcggcccgtaaccgttcgggttaacctcgttcgttccgttcccttaacgtccgtcccgtttacccgacccggttaaccgggtcccttaacggtttcccccgg

SEQ ID NO: 363110 - DNA, 546 bp, Homo sapiens
  misc_feature: GZ8MTXP01EFY1M.44.86.H09.1.454.CMB.2.raw
  modified_base (365)..(365): a, c, t, g, unknown or other
  modified_base (483)..(483): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggacggggaagtggagtggattggtgacatccattatacgtgggcgacgtactactctccgtcccctcaagagtcgtctacacctntttcgagggacacgtccatcgaaacccgcttctccctagaaactcgacctccgtcgacccgccgcggaccacggtccgtttatttcgtgtgcgaggcgagactggtcttcaatctagnggggctggcaccttggtcattcgttcttccgtcacgcttccacgaacgggcccaagttcccgg

SEQ ID NO: 363111 - DNA, 611 bp, Homo sapiens
  misc_feature: GZ8MTXP01EWX6U.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggattccatcagttctgatctattcgttggggctggactccggcacgcccccgagggacggggaagtgggagtggagttggtgacatcattagtacgtggggcgacgtactactctccgtcccctcaagagtcgtctacacctgtttcgagggacacgtccagtcgaacccgtcttcctccctacgtaaactcgacccgttccggtacgacccggcccggcggacctaccgggtccgttttatttccgtggtcgaccggaggcgagtacgttggttctttcgaacttccgtaggtcggggccgtggcctacccgttggtactcgttcgttccttcccgtcacggtccttccgacccgttaacgggtccccttaacgtttccccgg

SEQ ID NO: 363112 - DNA, 628 bp, Homo sapiens
  misc_feature: GZ8MTXP01EZRXV.44.86.H09.1.454.CMB.2.raw
  modified_base (243)..(243): a, c, t, g, unknown or other
  modified_base (391)..(391): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngtatcattcgttggggctggatccggcgacgccccgaggggacgggaatgggagtggagttggagacatacctattatacgtggggcgacgttactactctccgtcccctcaagacgtcgtctaacacctaagtttcggagggtaccncgtacctactcgaaacccgtccttactccctaggaaacttcgacccgttcccggtcgacccggccgaccggacgaccggtccgtttaagtttcgtggtacggcgacgggacgacgacgttgggtaccttttacagttacgtacggtcggggccgttgggcctacccgttggtaccacgttcgttccttccttcggactcctttacccgaccgttaacgggtcccaacgtttccccgg

SEQ ID NO: 363113 - DNA, 562 bp, Homo sapiens
  misc_feature: GZ8MTXP01BXN4E.44.86.H09.1.454.CMB.2.raw
  modified_base (368)..(368): a, c, t, g, unknown or other
  modified_base (477)..(477): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcttggggctggatccggcacgcccccgagggacggggaagtggagttgagttggtgacagtccattatacgtggggcgacgtactactctccgtcccctcagagtcgtctacacctntttcgagggacacgtccatcgaaccgcttcgtccctagaaactcgacctccgtcgaccgccgcggacacggtccgtttattcgtgtgcgaggcgagacgttggtccttnaatctagtcgggccgtggcacccgttggtccagttcgttccttcctcacgtccttcccaccgaacgggtccccaagtttccccgg

SEQ ID NO: 363114 - DNA, 793 bp, Homo sapiens
  misc_feature: GZ8MTXP01C0LCP.44.86.H09.1.454.CMB.2.raw
  modified_base (220)..(220): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcagcatctcctgcagttgggancagactccaaacatcgggacaggtattctgatgtccactcggtaacccaacgaccttaccgaaggaaaccaccgacccccaaaactccctactactttactttaggtaaacctaaaccttacgtccggccccttacgacggggttccctcggaacccccgtatttcgtcgtcggtaccctaacccgtaaacgttccgttcgggaccctaacccgttcgaccgtccccttccccgtcggtaccctaacttcccgaaccgttcggggtacccttcccgaacggggtccgttagggaaacgtaacgtcggggtaaacgggggtttacgttaattttaacggttttaacgcggttacccgtaaggttaccccttaagttacgggaaccttaacggccgtaacgggtaccccttcgggttaaggggtttcgggggtttcgggggttgggttttacccgggggacggggttaaacggggaacccgttaaaggttcccgttaacggggtaaccccgggttcccgggttcgggggttaccctaaccgggttccccggaaacgggttcccgtaacccccggg

SEQ ID NO: 363115 - DNA, 614 bp, Homo sapiens
  misc_feature: GZ8MTXP01EDHQF.44.86.H09.1.454.CMB.2.raw
  modified_base (379)..(379): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgagggaggggaatggagtggagttggtgacatccattagtacgtggggcgacgtactactctccgtcccctcaagagtcgtctacacctgtttcgagggaccncgtaccatcgaaccgtcttctccctagaaactcgaccctccgtcgacccgccgacggacctaccgggtccgtttatttcgtgttggcgtaggcgagtacgttggttaccttttcgaattcgtaacgtcgggggtcccgttggcccgtaccccgttgggtcctaccgttcggttccttcccgtcgacgtcccgtttaccccgaccgaaccggggtccccttaacgtttcccccggg

SEQ ID NO: 363116 - DNA, 567 bp, Homo sapiens
  misc_feature: GZ8MTXP01A6WAW.44.86.H09.1.454.CMB.2.raw
  modified_base (306)..(306): a, c, t, g, unknown or other
  modified_base (347)..(347): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattccaccttcaacagacatggcatgcacgtgggcccnccaggcctccgaggcgaagggctgggagtgggtgcacttanacgtggtatgatggaaaataattaatattatacgtagtattccgaggaaacgggcctatccacatcctacagagacaagttacgaaagaacactaacttaaggtacttacgtaaggaaatagaaatcgccgtaggaagtacggaccggaaggacaacgggtacttgtacttacgtacgtggttagcgaggaagtagtggggctggaggtaattaacgaag

SEQ ID NO: 363117 - DNA, 856 bp, Homo sapiens
  misc_feature: GZ8MTXP01BBT68.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaacctgtctctcatctgcactgtctctggtagtttccatctagttctgatctattcgtgggctggatccggcacgccccgagggagggaagtgggagtggagttggtgacgtatacctagtttacgtacgtgggggaccgtaacggttaaccttaaccgttccgttaccccggttacccccccttaccgtaaacggtacggttcccgttaccgtaaccctaaacccgtaacgttttcccgggaaacggggtaacccgtaacccggtacccgtaacgtaccgggtaaaaccccggttcccgtttaccctacccccgttaacggtaaaaccttcccgggtaaccccgttaccccgggttaaccggaccccgggaccccgggtaccgggtacccgtaacccggggttccgttttttaaacgttttcggggttacgggttcgggtaccggaacggggtaccggtacggtaaccgtttcggggtttaccttttaccgtaaacgttccggttaacgggttccgggggtcccggttcggggttcccgtaaaccccggtttcgggttaacccgtacgttcggtttcccgttaccctccgtaaccggtccctttaacccccgaaccgggttaaacccggggtcccccttaacggttttcccccggg

SEQ ID NO: 363118 - DNA, 596 bp, Homo sapiens
  misc_feature: GZ8MTXP01DUSLZ.44.86.H09.1.454.CMB.2.raw
  modified_base (589)..(589): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgtgggctggatccggcacgaccccgagggacgggaatggagtggagttggtgactatacatttatacgtgggacgacgttactactctccgtccccctacgaagacgtcgtctacgacctgttcggacgggtacacgtccattacgaacccgtcttctacctacgaaacctcgaaccctccggtcgacccgccggccggacgtcggttaccgtttactttcggtgtcggcgacgggtcgaagtccgttggttacctttctaattcgttaggtcggggtcctcgggcctacccgttggtctacttcgttcttcctcgatccttcgaccacgggtcccngttcccg

SEQ ID NO: 363119 - DNA, 598 bp, Homo sapiens
  misc_feature: GZ8MTXP01E0ZF7.44.86.H09.1.454.CMB.2.raw
  modified_base (475)..(475): a, c, t, g, unknown or other
  modified_base (554)..(554): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacgggaagtggagtggattggtgacatccagttagtacgtggggtcgacgtactactccgtccgtccccctcgaagagtcgtctcacctgtttcggacgggacacggtccagtcgaaccgtcttactccctagaaactcgaccctccgtacgacccgccgcgaccgtacggtccgtttacttcgtggtgcgnggcgagtacgttggtctttacaattcgtagtggggccgttggcctacccgttggtcctacgttcggttccttccgtaanaccgtctttcccgaccgaaccggggcccttaagtttcccccggg

SEQ ID NO: 363120 - DNA, 613 bp, Homo sapiens
  misc_feature: GZ8MTXP01A4KV4.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaaccctgtctctcatctgcactgtctctggtatttccatctagttctgatctattcgttgggctggacgtccggcgacgccccgaggggacgggaagtggagtggagttggtgactatcctattacgtacgtggggacgacgttactacgtcctccgtcccctacgaagtacgtcgtctacaccctgttcgacgggacaccgtccagtacgaaccgtccttacctaccctagaacctcgtaccctccgtcgacccgccgcggacaccggtcgtttattcgtgtgtcgacggtcgacgacgttggtcctttacgaaacgttcgtaggtcggggtccgtcgccgtacccgttgtcgtaccgttcgttccttcccgtctacgtcccttccgaccgttaacgggccccttcgttccccgg

SEQ ID NO: 363121 - DNA, 588 bp, Homo sapiens
  misc_feature: GZ8MTXP01BO8PW.44.86.H09.1.454.CMB.2.raw
  modified_base (450)..(450): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtatttccatctagttctgtatcattcgttggggctggactccggcacgccccgagggacgggatggagtggagttggtgacataccattagtacgtgggacacgttactactctccgtcccccacagcgtctctcacctgttcgacgggactacgtccatcgaaccgtcttctcctagaactcgacctcgtcgaccgccgacgacgacgtctttacttcgnggtgccgaggcgagtcgtggttcttcgtaatcgtagtcggggccgtggccctaccgttggtacctacgttcgttcccttccctaacgtaccggtccctttcccgaacccgttaaccgggcccttaacgtttcccccgg

SEQ ID NO: 363122 - DNA, 590 bp, Homo sapiens
  misc_feature: GZ8MTXP01DE4KH.44.86.H09.1.454.CMB.2.raw
  modified_base (375)..(375): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtatttccatctagttctgtatctattcgttggggctggatccggcacggcccccgaggggacggggaagtggaggtggagttggtgacatccattatacgtggggcgacgtactactctccgtccccctacagagtcgtctcactntttcgagggacacgtccatcgaacccgtcttctccctagaaactcgaccctccgtcgacccgtccgcggaccacggtccgtttattcgtgttcggcgaggcgagtacgtggttactttctaaattcgtagtcggggccgtggcccgtacccgttggtcctacgttcgttccttcctcacgtccttcccgaccgacggtcccttaacgttccccgg

SEQ ID NO: 363123 - DNA, 580 bp, Homo sapiens
  misc_feature: GZ8MTXP01EJ55W.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggactccggcacgccccgaggggacgggaagtgggagtggagttggtgactatcctatttagtacgtgggggacgacgttactactctccgtccccctacaagacgtcgtctaccactgtttcgagggacacgtccatcgaaccgtcttctccctagaaactcgacctcgtcgaccgccgcgacacggtctttattcgtgtgcgaggcagcgttggttactttcaattcgtaggtcggggtccgtcggccacccgttgtcctacttcgttccttcctcgacgtcccttaccgaccgacggtcccttaacgtttccccgg

SEQ ID NO: 363124 - DNA, 572 bp, Homo sapiens
  misc_feature: GZ8MTXP01DV3IB.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaagtggaggtggagttggtgacgatccattatacgtgggcgacgtactactctccgtccccctacaagagtccgtctaccacctgtttcgagggacacgtccatcgaaccgtcttctccctagaactcgacctcgtcgccgcgcggacacggtccgtttatttcgtgttgcggtaggcgtagacttggtctttcaattctacggtggggccgttggcctacccgttggtctacttgttccttccgtcacgtccttcccgaccgacggtccccaagtttccccgg

SEQ ID NO: 363125 - DNA, 589 bp, Homo sapiens
  misc_feature: GZ8MTXP01BO49Y.44.86.H09.1.454.CMB.2.raw
  modified_base (488)..(488): a, c, t, g, unknown or other
  modified_base (530)..(530): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgtatctattcgttggggctgggatccggcacgcccccgagggaggggaatggagtggagtggtgacataccattatacgtgggacgacgttactacgtctccgtccccctcaagacgtcgtctacacctgtttcgacgggacacgtccatacgaaccgctttctccctagaactcgtaccctccgtacgacccgtcgcgacgacggtaccgtttagttcgtgtgcgagacaagcgtggttcttntaactcgtaggtcggggcgttcggccgtacccgttggtaccncgttcgttccttccgctcggtccttacccgacggaaccggtcccgttaacgttccccgg

SEQ ID NO: 363126 - DNA, 615 bp, Homo sapiens
  misc_feature: GZ8MTXP01CH2HD.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggatttccatctagttctgatctattcgttggggctggatccggcacggccccccgaggggacggggaagtgggagtggagttggtgacagtccattatacgtgggggcgtacgtactactctccgtccccctcagtacgtcgtctaccacctgtttcgagggacacgtccatcgaaccgtcttctccctagaaactcgacctcgcgtaccgccgcggacaccggtcgtttatttcggtgttcgcgacggcgacgtacgttcggttctttactaaagttcgtacggtcgggggtcccgttacgggccgtaccccgttggtacccgtcgttcggttccttccctcgtacgtcccttacccgaccgaaccgggtcccttaacgttcccccgg

SEQ ID NO: 363127 - DNA, 669 bp, Homo sapiens
  misc_feature: GZ8MTXP01ASA9T.44.86.H09.1.454.CMB.2.raw
  modified_base (619)..(619): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgctactgtctcgtggtatttccatctagttctgatctattcgttggggctggatccggcacggccccgaggggagggatgggaggtggagttggtgactatacctagttagtacgtgggggccgtaacggttactacgtcctcccgtcccctacaagtacgtccgtctacaacccgtcgtttcggagggtaccacggtccaagtacgtaacccgtcttacctaccctagtaacctcggtaccctccgtacgacccggccggtaccggaccgtaccggtcgttttacgtttcggtggttcgggcgacgggtcgagtacgtttgggttacctttcgtaacttcgttacggtcggggtcccggtcggccgtaccccgttgggtcctaccgttcgttccttcccgtccncggtcccttacccgaccgttaaacggggtccccttaacgtttcccccggg

SEQ ID NO: 363128 - DNA, 626 bp, Homo sapiens
  misc_feature: GZ8MTXP01DGVHL.44.86.H09.1.454.CMB.2.raw
  modified_base (381)..(381): a, c, t, g, unknown or other
  modified_base (419)..(419): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccattcagtttctgatctattcttggggctggatccggcacggcccccgaggggacggggaaagtgggagtggagttggtagactatcctattatacgtggggcgtacgtactactctcccgtccccctcaagacgtcgtctcacctntttcgagggtacacgtccagtacgaaacccgtctttcnccctagaaactcgaccctccgtcgacccgccgacgactacggtcctttattcgtgtgcgtaggccgagacgtggttctttacgtaatcgtacgtcgggggtccttcggccgtaacccgttgggttaccaacgttcggttcccttcccttcgtaaccgtcctttaccccgaccgttaaaccggggtcccccttaacgtttcccccggg

SEQ ID NO: 363129 - DNA, 665 bp, Homo sapiens
  misc_feature: GZ8MTXP01CE5MJ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtatttccatctagttctgatctagttcgttggggctggacgtccggcgacgccccggagggacgggaagtgggagtggtagttggtagacgatcctagtttacgtacgtcgggggacgtacgttactacgtcctccgtccccctcaagtacgtcgtctaacactgttcgaacgggacacgtccagtcgaaccgtccttctaccctagtaaactcgtaacccgtccgtacgaccgccgacggaccgtaccggtccgtttacgttcggtcgtcggacggacggtcgacgtaccgttggtttacctttacgtaaagtccgttacggtcgggggtcccgtacgggttcccgtacccgttgggtaccctacgttccgttcccgttacccttcgaccttcccgttacccgacccggaaccgggtccccttaacggttcccccgg

SEQ ID NO: 363130 - DNA, 571 bp, Homo sapiens
  misc_feature: GZ8MTXP01DA3FW.44.86.H09.1.454.CMB.2.raw
  modified_base (351)..(351): a, c, t, g, unknown or other
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctggggctggatccggcacgcccccgagggacggggaatggagtggagttggtgacatccattatacgtggggcgacgtactactctccgtcccctcaagngtcgtctacacntttcgagggacacgtcatcgaaccgtcttctcctgaaactcgacctccgtcgaccgccgcgacacggtccgtttattcgtcggtgcgtaggcagtacgtggttactttctaattcgtagttcgggggccttcggccgtacccgttggtccacgttcgttccttccgtcacgtccttccaccgttaacgggtcccttaacgttccccgg

SEQ ID NO: 363131 - DNA, 642 bp, Homo sapiens
  misc_feature: GZ8MTXP01A6SCO.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtatctattcgttgggctggactccggcacgccccgaggggacggggaagtggaggtggagttggtgactatcctattagtacgtggggcgtacgttactactctccgtccccctcaagtacgtcgtctacacctgtttcgacgggtacctacgtccagtacgtaacccgtcttacctaccctagtaaacctcgacccgttccgtcgacccgccgcggactccggtcgtttattcggtgtcggtcgacggtcgtacgtcgttcggttactttacgtaagttcgtaggtcgggggtccgtcgggacctacccgttgggttccctcgttcggttccttcccgtaactccgtccttacccgaaccggttaaccgggtcccttaacggtttcccccgg

SEQ ID NO: 363132 - DNA, 595 bp, Homo sapiens
  misc_feature: GZ8MTXP01CG3DF.44.86.H09.1.454.CMB.2.raw
  modified_base (312)..(312): a, c, t, g, unknown or other
  modified_base (564)..(564): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggagtttccatctagttctgatctattcgttggggctggactccggcacgcccccgaggggacggggaagtggagtggagttggngacatacctattatacgtggggcgtacgtactactctccgtccccacagcgtctctaccacctgttcgacgggaccacgtccacgtcgaacccgtcttcctccctagtaacctcgacctccgtacgccgccgacgacgtaccggtcgtttattcggtgtcgtcggacggcgtacgtacgttggttcttcgtaattcgtacggtcggggtccgtaggttccctaccgttggtacctcgttcgttccttcgtcncgtcctcccacgacggtcccttcgttccccg

SEQ ID NO: 363133 - DNA, 770 bp, Homo sapiens
  misc_feature: GZ8MTXP01CHGUG.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggacttcaccttcaacagacagtggcatgcacgtcgggtcccgccaggcctccgaggcgaaggggactgggaggttggggtgctacgtttatacgttggtatggaatagggtaaaaagttaaattaaattatttaaagtggttaagtaacgtttcccgggtaagggaaaccggggtacccgtaatttacccgaaccctaacttaccgttaccccgaaggtaaacggtaaccttaaaacgtttacccggaaaacgtaaaccctaacctaaactttaaacttaacgttaaccggttaaaggtaaaacgttagtaaaacgtttacggacccgtttaaggggaaacggtaaccgggtacccggggaaacgggaccgtaaccgggggtccttacgggttaacccttaaaccgttaaccgttgggttacgggacccgggttaagggtaacgggtacggggttcggggggaccgtttaccggggttaagggtaacgttaaccgtaaaggg

SEQ ID NO: 363134 - DNA, 575 bp, Homo sapiens
  misc_feature: GZ8MTXP01BTAKU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggactccggcacgcccccgagggacggggaagtggagtggagttggtgacatccattatacgtggggcgacgtactactctccgtccccctcaagagtcgtctaccacctgtttcgagggtaccacgtccactacgaacccgtcttcctacccgtagaaactcgacctccgtcgacccgtccgcggacacggtaccgtttattcgtgttgcgaggcgagacgtggttcttctaatctagtcggggcctggctacccgttggtcacttcgttccttcctcgacgctttcccaccgacgggcccttaagttccccgg

SEQ ID NO: 363135 - DNA, 585 bp, Homo sapiens
  misc_feature: GZ8MTXP01B6KES.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgaggggacgggaagtggagtggagttggtgacatcctattactacgtgggcgtacgtactactctccgtcccctacagtgtcgtctacactgttcgagggacacgtccatacgaaccgtcttctacccgtagtaacctgaccctccgtcgaccgccgtacgacacggtccgtttattcgtgtgcgaggcgagacgttggttctttacaattcgtacgtggggccgtggcctacccgttggtacctcgttcgttccttccgtcacgtccttacccgaccgttaacgggtccccaagtttccccggg

SEQ ID NO: 363136 - DNA, 623 bp, Homo sapiens
  misc_feature: GZ8MTXP01A36G1.44.86.H09.1.454.CMB.2.raw
  modified_base (560)..(560): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgcccccgaggggacggggagtgggagtggagttggtgacgatcctattagtacgtggggacgtacgtactactctccgtccccctactagtacgtcgtctaccacctgtttacgagggaccacgtccactcgtaaccgtccttactcccgtagtaaacctcgaccctaccgtcgacccgccggcggaccgtacggtccgtttattcggtcggtgccgaggtcgacgtacgttggtacttttcaagttcgtacggtggggtcccgtggttccgtcccgttgggtccncgttcgttccttcctcctacgtccttacccgaccgaaccggggtcccttaacggttcccccgg

SEQ ID NO: 363137 - DNA, 560 bp, Homo sapiens
  misc_feature: GZ8MTXP01AIGZ6.44.86.H09.1.454.CMB.2.raw
  modified_base (458)..(458): a, c, t, g, unknown or other
  modified_base (509)..(509): a, c, t, g, unknown or other
  modified_base (525)..(525): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcgacgcccccgaggggacggggaagtggaggtggagttggtgacatcctattagtacgtggggcgacgtactactctccgtcccctcagtacgtcgtctacacctgtttcgagggacacgtccatcgaaccgtcttctcctagaaactcgacctccgtcgaccgccgcgacacggtcgtttattcgngtgcgagcgagcgtgtcttcaatctagtcgggcgtcggcaccgttggtacncttcgttccttcctcncgtccttccgaccgacgggtcccttaagttccccg

SEQ ID NO: 363138 - DNA, 614 bp, Homo sapiens
  misc_feature: GZ8MTXP01EXMWW.44.86.H09.1.454.CMB.2.raw
  modified_base (396)..(396): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctatttcgttggggctggactcccggcacgccccccgaaggggaggggaaagtgggaggtggagttggtagacataccgtatttagtacgtgggggacgacggtacctaactccgtcccgtccccctcaagtacgtcgtctacacctntttcggagggacacgtccagtcgaacccgcttctccctagaaactcgacccgtcccgtgacccgtccgacggaccgtacgtccgtttattccggtgtcgcgtaggcgagtacgtggttaccttcgtaaattcgtagtcgggggccgtcgggcctacccgttgtcctacgttcgttccttcctcacgtcctcccaccgaacggtcccgaagttccccgg

SEQ ID NO: 363139 - DNA, 572 bp, Homo sapiens
  misc_feature: GZ8MTXP01BTS7Q.44.86.H09.1.454.CMB.2.raw
  modified_base (530)..(530): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagtttccatcagttctgatctattcttggggctggatccggcacgccccgagggacgggaagtggagtggagtggtgactatcctattatacgtgggcgtacgtactactctccgtccccctcaagcgtcgtctaccacctgtttcgacgggacacgtcatcgaaccgtcttcctcctagaaactcgaaccctccgtcgacccgcgccgactacgtcgtttattcgtgtgcggaggcgacgtacgtcggttacttctaattcgtagtcggggccgtcgctacccgttggtctacttgttccncctcacgccttcccgacgaacgggtcccttaacgttccccgg

SEQ ID NO: 363140 - DNA, 582 bp, Homo sapiens
  misc_feature: GZ8MTXP01BUZKQ.44.86.H09.1.454.CMB.2.raw
  modified_base (435)..(435): a, c, t, g, unknown or other
  modified_base (541)..(541): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggcccaggactggtgaggccttcgggaacctgtctctcatctgcactgtctctggtactttccatctagttctgatcattcgttgggctggactccggcacgccccgagggacgggatgggagtggattggtagacagtccattagtacgtgggcgacgtactacctctcccgtcccctacagcgtcgtcctaccactcttcgaggacacgtccagtcgaaccctcttctccctagaactcgaccctcgtcgaccgccgcgacncggtctttacttcgtgtgcgacggcgacgtacgtgttacctttcgaattcgtacggtcgggggcctcggccgtacccgttcgggtcctacgttcgttcttccgtcncgccctttcccaccgttaacggtcccttaacgtttccccgg

SEQ ID NO: 363141 - DNA, 688 bp, Homo sapiens
  misc_feature: GZ8MTXP01D4PQL.44.86.H09.1.454.CMB.2.raw
tcagacagtatatacacgaccggtgctcgatttagtgctatagacttgggtttggggatgctttctgagagtcaaggacctcctgtgcaagaacatgaagcaccttgttggtttttcctcctgctggtggcagctcccagatgggtcctgtcccaggtgcagctgcaggagtcgggcccaggactggtgacggtccttcgggaacctgtctctcatctgcactgtctcgtggtactttccatctagttctgtatctattcgtgggctggacgtcggacacggaccccgagggagggagtggagtggtagttggtagactatactattagtacgtggggacgtacgttactactccgtccgtacccctacgaagtcgtcgtcctaaccacctgtttcggaacgggtacctacgtaccagtacgtaaccgtccttacctacctacgtaaaccgtcgaacccttaccggtaccgacccggtccggaccggtaaaccgtaccgggttaccgttttaacgtttcgggtacggttacgggaccggtaacgggtcgtacgttacgtttcggtttaccttttacgtaaacgttcggttacggtccggggtaaccgtcggaccgtcccggttgtccgtacttcggttccttaccgtcgtacgtcttacccgaccgttacggtcccttcgttccccgg

SEQ ID NO: 363142 - DNA, 552 bp, Homo sapiens
  misc_feature: GZ8MTXP01CCGL6.44.86.H09.1.454.CMB.2.raw
  modified_base (370)..(370): a, c, t, g, unknown or other
  modified_base (464)..(464): a, c, t, g, unknown or other
  modified_base (475)..(475): a, c, t, g, unknown or other
  modified_base (508)..(508): a, c, t, g, unknown or other
  modified_base (543)..(543): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcacggcccccgaggggaggggagtggagtggtagttggtgacatcctattatacgtggggcgtacgtactactctccgtcccctcagtcgtctctcacctnttcgaggacacgtccatcgaaccgtccttctccctagaactcgaccctccgtcgaccgccgcgacgacggtcctttagttcgtgtgcgaggcgngctggttcttntaatcgtacgtggggccgtggccaccgttgtcncttgttcttcctcactccgtaccacgacggtcccncgttcccgg

SEQ ID NO: 363143 - DNA, 602 bp, Homo sapiens
  misc_feature: GZ8MTXP01BC8QL.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttgggctggatccggcacgcccccgagggacggggaagtggagtggagttggtgacatccagttagtacgtggggcgacgtactactctccgtcccctcacgtacgtcgtctcacctgtttcgacgggacacgtccatcgaaccgtcttacgtcctgaaactcgacctccgtacgaccgccgacggactacggtccgtttaatttcggtgttcggccggacggcgtacgacgttgggttctttacgaaattcgtagtcggggtccgttcggcctacccgttggtcctacgttcgttccttcccgtcacggtccttcccgaccttaaccggggcccttaacgttccccggg

SEQ ID NO: 363144 - DNA, 734 bp, Homo sapiens
  misc_feature: GZ8MTXP01CQC41.44.86.H09.1.454.CMB.2.raw
  modified_base (290)..(290): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtggtccagccgtgggagtccctgagactctcctgtgtagcgtctggattcaccttcaacagacntggcatcgcgtacgtcggggtcccgccaggcctccgaaggcgaaggggactgggaggtgggtgacctattagtagtggtatgaagtaggaaaaaagttaaattaaagtatttaagtaggtaacgtacgtttacccgggtagggtaaacggggtacccttaacgtttacccaaaccgtacttaccgtaaccccgaaaggtaaccggtaaactaaaacgtttacgaaaaacgtaaaccaacctaaaccttaataacgttaacgtaaggtaaaaacttaggtaaacttaacggacccgttaaaggaaacggtcgggaaccccggaagggaacccgtaaccggggtacttacggttacttaacccgtaacgttacgggttgaccggttaaaggaacgggtaagggttcgggggtcgtaccgggtttagggaaagttaaccgtaaaggg

SEQ ID NO: 363145 - DNA, 672 bp, Homo sapiens
  misc_feature: GZ8MTXP01BI9LG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcgagggagtcgggcccaggactggtgacggccttcgggaaccctgtctctcatctgcactgtctcgtggtagtttccatctagttctgtatctattcgttggggctggatccggcacgccccgaggggacggggaagtggaggtggtagttggtgtactagtacctagtttagtacggtgggggtcgtacggttactacttcctccgtcccccctacgtaaagtacgttccgtcctaacctacctgtttcggaacgggtaccacgtccactacggaaaccccgtcttacctcctacgaaacctcgtaccctaccgtcgacccgcgaccggacgaccgtccgtttatttcggtggttggcgtacgggcgtacgtacgttgggttacctttacgtaacgtccgttagggtcgggggaacccggttcggacgtccccgttgggtacctcgttcggttcccttcctctaccgtccttacccgaccgttacccgggtcccttaacggttccccgg

SEQ ID NO: 363146 - DNA, 621 bp, Homo sapiens
  misc_feature: GZ8MTXP01AEU7H.44.86.H09.1.454.CMB.2.raw
  modified_base (311)..(311): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagccgtgggacgtccctgagactctcctgtgtagcgtctggacttcaccttcaacagacatggcagtgcacgtcgggtccnccaggctccgaggcaaggggctgggaggtgggtgctacgttatacgtggtatggaatagggtaaaaaacttaaattaaattgtttaaactggtaagtacgtttccgggtaaggaaacgggtcctagttccaaccgtatcctacccgaagtacgaactaacgttacgaaacgtaaacactaactagtatacgtaggaaactgaaatacgctaggacgtacgccgaaggaccgaacgggtcttaggtccttaaacgtcgttaggttcgacggaggaaggtaggtcggggccttggttaggtaattaacgaag

SEQ ID NO: 363147 - DNA, 727 bp, Homo sapiens
  misc_feature: GZ8MTXP01CMCYZ.44.86.H09.1.454.CMB.2.raw
  modified_base (228)..(228): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgccctcagtgtccgtcggggccccagggcaggagggtcagcatctcctgcactggaaccaanagtgacgttcggttcgttttgaccgtgtctccgtaggtaccagcacgaccccaagaaaccaccgacccccaaatctatttatttatcgtcgtacaacttcgttcccgtcccgtttcggtcgtccctgacgcgtcctttccgtccggtggtaccaagttcccgtacgggaccaaccgtccggtcccctccgtacgaccctattccgtcgtcgggtctacccgaggtccgtggaacgggacgtacgggccttaggttaactttaacgttaccgtggacctacgggtacttacgtaattaacgtaaacggtaaacggttacgggtaaacctttacgttttaaccgtagtttccggggacctacggaaaccggggaaccttaaacggggtccttaacccgggtaaccccggtttcggttaaccggttccgaacccgggaacccgtaaaccggggtccctccccggtcccccgttcgggtaaccccttaaccgtttcccccggg

SEQ ID NO: 363148 - DNA, 615 bp, Homo sapiens
  misc_feature: GZ8MTXP01C7YTO.44.86.H09.1.454.CMB.2.raw
  modified_base (207)..(207): a, c, t, g, unknown or other
  modified_base (320)..(320): a, c, t, g, unknown or other
tcagacagtatatacacgaccggtgctcgatttagtgctatagacttgggtttggggagcttcagctgtggtagagaagacaggattcaggacaatctccagcatggccggcttccctctcctcctcaccctcctcactcactgtgcagggtcctgggcccagtctgtgctgactcagccatcctcagcgtcgtcgggacccccggnagacggtcacgattcttttgtctggaagtaggtccaacatacggaataattacgtatactggtatcggcaattcacgaggagccggtccccagacccctgatctagtaggganaatcgagcggccctcgacggggtccctgaccgtattcccgtcctagccctaccaagtcctggccacctcacgtcccctcccgtcggccactcaggtcggcgtcccgggtccgaggagttcggaggtctagtactttagtttcgtggtcgggcgggtcggttaggggattcgacgttacgttccgtaggtagtcggtacctggtccttaaggttccgggacgggacggacgtaaacggtcttacggacccgttacgtaacgtccgcggtacccgacggccttcccgccccgttcgg

SEQ ID NO: 363149 - DNA, 587 bp, Homo sapiens
  misc_feature: GZ8MTXP01A3S4L.44.86.H09.1.454.CMB.2.raw
  modified_base (309)..(309): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagctctcctgtgtagcgtctggacttcaccttcaacagacatggcatgctacgtcgggtcccnccgaggcctccgaggcgaaagggctgggagtgggtgctattatagtggtatgataggtaaaattaataatattagtagtagtattacggaggaacgggccctattcacctagtcctacaagagaactaagtacgaaagtaacactaactataactacgtaagtaaattgaaactgacctaggaggtacgaccggaaggcgaacggtcttgttaccttacgtacgtggttcggagaggtaaggtaggtcggggctacgggttaggtaacttaacgtaag

SEQ ID NO: 363150 - DNA, 669 bp, Homo sapiens
  misc_feature: GZ8MTXP01AF32U.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacttccatctagttctgatctattcgttgggctggactccggcacgccccgaggggacgggtagtggagtggtattggagacatacctagttagtacgtggggacgtacgttactactccgtccgtccccctacgaagtcgtccgtctaacaccgtgtttcggacgggacacgtccagtcgtaaacccgtcttcctacccgtagaaaccgtccgaacccgtccgtcgacccgccgacgaccgtacgtccgtttattcgtgtcgcggtacggcgtagtacgttggttacctttcgaacgttcgtacgggtcgggggtccgtcgggttccgtacccgttacgggtccgtaccgttccgggttccgttcccttccgtccgtaacccgtttaccccgaccccgggttaacccgggtaacccggttaacccgtttcccccgggg

SEQ ID NO: 363151 - DNA, 682 bp, Homo sapiens
  misc_feature: GZ8MTXP01BFHEO.44.86.H09.1.454.CMB.2.raw
  modified_base (285)..(285): a, c, t, g, unknown or other
  modified_base (654)..(654): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtggtccagccgtgggagtccctgagactctcctgtgtagtcgtctggtacttcaccttnaacagacagtggacagtcgccacggtcgggtcccgaccgaggtccctaccggaaggacgaaacgggggtacgtggggtacgggttgggggtcggtactacgtttaagtagtagggtatggaaacgtagggtaaaaaaagttaaataaagtttattaaagttacggttaaagtacgtttacccgggtaaagggaaacgggtcctaacttaccaacccgtattccgtaaccgaaaggtaacgaaactaaacgttaacgaaacgtaaacaactaaacttaactaactacgtaaggaaatagaaactacgacctaagacgacggacggaacgaccgaacggtcttcgtacttaccgtagtcgttgagagaagngtcgggactcggttagaacgttaagaag

SEQ ID NO: 363152 - DNA, 659 bp, Homo sapiens
  misc_feature: GZ8MTXP01BO4JB.44.86.H09.1.454.CMB.2.raw
  modified_base (200)..(200): a, c, t, g, unknown or other
  modified_base (359)..(359): a, c, t, g, unknown or other
  modified_base (448)..(448): a, c, t, g, unknown or other
  modified_base (467)..(467): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggccaggnggtcagcatctcctgcagttgggagcggctaccgaagaggcggggtctaggtttgattgtacaagtcggtaccagactaaccttcgaacggaaccaccgaccccaaatcgacctactattaccgactaacacctacgttccggcctacgacgggtcccngacctacttcacgacggtcctacccgaaagtccgtgaccctaacctccgaccgtccccttccgcgacccacgtccaccggtcgggtacnccggaggtctagggagcgnggtacgtctaagttactttacggtacgtacgccgtaacgtacctagtacgtacgtagttacgttcgtaggttacggtcgggtgggtttcgggggttcgggttacgggacggggtaaacggtacggttaacgggttcggacccggttaacgtcggtaaccgaccggacccgacggtcccgttcccgtccccgg

SEQ ID NO: 363153 - DNA, 755 bp, Homo sapiens
  misc_feature: GZ8MTXP01B6FRT.44.86.H09.1.454.CMB.2.raw
  modified_base (714)..(714): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcggaacctgtctctcatctgctactgtctctggtactttccatctagttctgtatctattcgttgggctggactccggcgacggcccccgaaggggacgggaagtgggaggtggagttgggtagacgtaatcccgtaattagtacggtgggggaccgtacgttaactactccgtcccgtccccctacgtaaagtcgttccgtcctaccgtaaccctaagtttaccgggaacgggtaccgtaaccgtcctaacgtacggtaaaccccgtccctttaccgtaccccttagtaaacccttccgtaaaccccgttccccggttaccggaccccggtacccgggaccgggtaaccctacccgggggtttacccgtttttaacgttttccggggttacggttacggggtacccggtaacggggtacggaacggtaccgtttcgggtttacctttacgtaaacgtttcgtaacggttcgggggcccgttaggccctaccgttcggtctacgttcgttcttccgtaacnctccgttaccaccgttaacgggtcccttaacgttccccggg

SEQ ID NO: 363154 - DNA, 571 bp, Homo sapiens
  misc_feature: GZ8MTXP01AT9DC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaagtgggagtggagttggtgacatccattatacgtggggcgacgtactactctccgtccccctcaagagtcgtctaccacctaatttcggagggaccacgtccatacgaacccgccttcctccctagaaacctcgacctccgtcgacccgccgcggacacggtccgtttattcgtgtcgcgaggcgagactggttcttcaattctagtcggggccgtggcctacccgttggtccacgttcgttcttcctcacgtccttccaccgacgggtcccaagttccccgg

SEQ ID NO: 363155 - DNA, 598 bp, Homo sapiens
  misc_feature: GZ8MTXP01EVV7M.44.86.H09.1.454.CMB.2.raw
  modified_base (383)..(383): a, c, t, g, unknown or other
  modified_base (561)..(561): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgtatctattcgttggggctggactccggcacggcccccgagggacgggaagtggagtggagttggtgacatacctattagtacgtggggcgacgtactacgtctccgtccccctacgaagacgtcgtctaacacctntttcgagggaccacgtaccagtacgaacccgtcttctcctagaactcgaccctccgtcgtacccgccgacgaccgacggtaccgtttagttcgtgtgcgaggcgtagtacgtggttacttcaattcgtaggtcggggtccgtggccctaccgttggtcctacgttcgttccttcctcncgtccttaccgaccgacggtccccttaagttccccgg

SEQ ID NO: 363156 - DNA, 616 bp, Homo sapiens
  misc_feature: GZ8MTXP01DCMJ1.44.86.H09.1.454.CMB.2.raw
tcagacagtatatacacgaccggtgctcgatttagtgctatagacttgggtttggggatgctttctgagagtcaaggacctcctgtgcaagaacatgaagcaccttgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgtatctattcgttggggctggatccggcacgcccccgaggggacgggaagtggaggtggagttggtgactatcctattagtacgtggggacacgttactactctccgtcccctacaagtcgtcgtctaccactgtttcggaggaccacgtaccatcgaaacccgtcttctaccctagaactcgacccgtcgtcgacccgccgcggacctacggtccgttttacttcgtaggtcggcgtacggcgaagtcgttggttacctttacgtaaacttcgtacggtcggggtcccgtggacctcccgttggtcctacttcgttccttccctcgtaccgtccttacccgaccgaacgggtccccaagtttcccccgg

SEQ ID NO: 363157 - DNA, 524 bp, Homo sapiens
  misc_feature: GZ8MTXP01B9JJ6.44.86.H09.1.454.CMB.2.raw
  modified_base (501)..(501): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggagcgtggtccagcctgggaggtccctgagactctcctgtgtagcgtctggattcaccttcaacagacatggcatgcactgggtccgccaggctccaggcaaggggactggagtgggtgcacttatatggtatgatggaaagtaataatattatgtagattccgtgaagggccgaattcaccatctccaagagacaattcgaaagaacacactatatctaggaaatgaatagctgagagccgaggacgaacggacttgtcttactaactgttggcgagaagagngggcgtcggttggtaagaagaag

SEQ ID NO: 363158 - DNA, 713 bp, Homo sapiens
  misc_feature: GZ8MTXP01B0WBQ.44.86.H09.1.454.CMB.2.raw
  modified_base (242)..(242): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgctactgtctctggattccatcagttcngtatctattcgtgggctggactccggctacgccccgaggggacgggaagtggagtggagttggtagactacgtacctaagtttacgtacggtcgggggacgtacgttaccttacgtcctcccgtacccctacgaaacgtacgtccgtacctacctaacctcgtttacggaacgggacctaccgtaccacgtacgtaaacccgtcttaccgtaccctagaaacctcgtacccgtaccggtacgacccgccgggacgaccgaccggtacgttttaacgttcggtggttcggacggtacgggtacgtacgtaccggttggttacctttaacgtaaacgttccgttaacgggtcgggggtcccggttacggttacccgttacccggttgttaacccgtcgttcggttccttaccccgtaactaccggtccctttacccgacccgttaaccgggtccccttaacgtttcccccggg

SEQ ID NO: 363159 - DNA, 778 bp, Homo sapiens
  misc_feature: GZ8MTXP01DMSFN.44.86.H09.1.454.CMB.2.raw
  modified_base (245)..(245): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccactctgtgctgacgcagcccgccctcagtgtcgtggggccccgggaggaggtcaccatctcctgcactgggagcagatccaacagtcgggacagattcngatgtccatggtaccaacaccttccaaggaaccacgacccccaaaactcctacattccgtttaggtaaacaacttagtcccggcccctcgacgggggtcccctaggacccgtatttccccgaccgttggaccctacccgaaagttccgttgggcccaaccctccgacggtcccctcccgtggacccaatcgacgtcggccaccgtagactaaggagtagtgggtaagggtagttaattacgttaaccgtcggacccgttaacgggttacccttaaggtactaaaacccgacggtccgaaacccggttccccgttaaagggttacggggtttcggggggtttgggggtttccggggtttaacccgggggacggggggtaaaccccggggaaacccgttaaaccggggtccgttaacccgggggttccccgggttaccccggggtttcgggggtaaacccgtaaccccggggtaaccccgggaaaccggggttccccgttccccccgggggttcccccccgttttaaccccgggg

SEQ ID NO: 363160 - DNA, 614 bp, Homo sapiens
  misc_feature: GZ8MTXP01BJKVD.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtatttccatcagttctgatctattcgttgggctggactccggcgacgcccccgaggggacgggaagtgggagtggtagttggtgactataccagtttatacgtggggacgtacgtactactctccgtcccctacgagtacgtcgtcctaccacctgtttcgacgggtacacgtccatcgaacccgtcttcctacctacgaactcgaccctccgtgacccgccgtcggacgtaccggtcgtttacttcggtgtcggcgacgggtcgaacgtcgttggttactttcgtaagttcgtagtcggggtccgtcgccgtaccgttcggtcctacgttcgttccttccgtcacgtccttcccgaccggttaccgggtcccttaacgttccccgg

SEQ ID NO: 363161 - DNA, 608 bp, Homo sapiens
  misc_feature: GZ8MTXP01AC8M7.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggaccggtgaggccttcgggaaccctgtctctcatctgcactgtctctggagtttccatcagttctgatcattcgttggggctggatccggcacgcccccgagggagggatggagtggagttggtgacatccattagtacgtggggcgacgtactactctccgtccctacagagtccgtctccaacctatttcgagggaccacgtccatcgaaccgtcttccctcctacgaaactcgaccgtcgtacgacccgccgacggaccgtccggtaccgtttagttccgtcgggtgcggaggccgaagtacgttggtcttttaccgaatcgttacggcggggtcccgtgggccttacccgtggttcacgttcgttacccttcttcctaacgtccttaaccgaccgacgggttccctaacgttcccgggtttcccc

SEQ ID NO: 363162 - DNA, 615 bp, Homo sapiens
  misc_feature: GZ8MTXP01BYNKP.44.86.H09.1.454.CMB.2.raw
  modified_base (358)..(358): a, c, t, g, unknown or other
  modified_base (576)..(576): a, c, t, g, unknown or other
tcagacagtatatacacgaccggtgctcgatttagtgctatagacttgggtttggggatgctttctgagagtcaaggacctcctgtgcaagaacatgaagcacctgtggtttttccttcctgctggtggcagctcccagatgggtcctgtcccaggtgcagctgcaggagtcgggcccaggacgtggtgaggccttcggaaccctgtctctcatctgcactgtctctggagtttccatctagttctgatctattcgttgggctggactccggcacggccccgaggggagggaagtggaggtggtagttggtgacatcctattagtacgtgggcgtacgtactactctccgtcccccanagtagtccgtctacactgttcgaacgggacacgtcatcgaacccgtcttcctcctacgaacctcgtaccctccggtcgaaccccggccggaccggtaccgtaccggttaccgttttacgtttcgcggttcggcggtaggacgacgtacgttggttacttacgtaagtcgttacggtcggggccgtcggccctacgttcgtctcttcgttccttcctcncgtccttacccgaccgttacggcccgttaacgttccccg

SEQ ID NO: 363163 - DNA, 752 bp, Homo sapiens
  misc_feature: GZ8MTXP01A3RJS.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtatttccatcagttctgatctattcgttggggcttggacgtccggcacggcccccgagggacggggaagtggagtggtagttggtagacgtatacctattacgtacgtacggggacgtacgttactacgttccgtccgtacccccctactaacgtacgtccgtactaccctaaccgtaacgtttacgggaacgggtaccctaccggttccaagtacgtaaacccgtcctttaccgtacccgtacgtaaactccgaacccgttcccggtacggaacccggtccggaccgggtacctaaccgggttccgttttagtttccggtcggttcggtacggacgggtaccggtacgtaccgtttcgggttacctttaccgtaaagttccgttaacgggtccgggggtaacccgtcgggttcccgttaaccccggttgggttccctaacggtttcgttcccgttcccctccgtaacgtccccgtttaacccgaaccccggttaaccggggtccccttaacggtttcccccggg

SEQ ID NO: 363164 - DNA, 588 bp, Homo sapiens
  misc_feature: GZ8MTXP01A6KR1.44.86.H09.1.454.CMB.2.raw
  modified_base (557)..(557): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggacgtccggcacgcccccgagggaggggaagtggagtggagttggtgacatcattatacgtgggcgacgtactactctccgtcccctcagagtcgtctaccactgtttcggagggacacgtccagtcgaaccctcttctccctagaaacctcgaccctccgtacgacccgccggacgacacggtccgtttattcggtgttgcggaacggcgtacgtacttgggttctttacgaagttcgtacggtcggggcgttcgccgtacccgttggtcctacgttcgttcttccgtaaccncgtcctaccgaccgaccggtcccttcgtccg

SEQ ID NO: 363165 - DNA, 542 bp, Homo sapiens
  misc_feature: GZ8MTXP01DLNI8.44.86.H09.1.454.CMB.2.raw
  modified_base (279)..(279): a, c, t, g, unknown or other
  modified_base (305)..(305): a, c, t, g, unknown or other
  modified_base (514)..(514): a, c, t, g, unknown or other
  modified_base (529)..(529): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttnaacagacatggcatgcactgggtccnccaggctccaggcaaggggctgggagtggggtgcactttatactgggtatgatgggaaaaattaaataagtattagtcgtaagattccgtagggaaggccgtattcacgatctaccagagactaattacgaaagaacaacactataactctaggaaatgaaatgctagagagaccgaggacaacggcttgtcttacgtatgttgcgagngagtgggggctcggnggtaagttcgaag

SEQ ID NO: 363166 - DNA, 687 bp, Homo sapiens
  misc_feature: GZ8MTXP01C6ROC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggacgtggtgacggccgttcgggaaccctgtctctcatctgcactgtctctggtattccatctagttctgatcattcgtgggctggactccggcacgccccgagggacgggaatggagtggagtggtgactatcctagtatacgtgggacgtacgtactactctccgtcccctacgaagtacgtcgtctacacctcgttcgacgggacacgtaccgagtacgaaacccgtcttctaccctagaaacctcgtaacccgtccgtacggacccgcccgggtaccggaccgtacgggttaccgtttaacgttttccggtgggtttcgggaccggtaacggggccgtaaacggtaccgttgggttaccgttttactaaacgttccgtaacggttccgggggtcccgtcgggttcccgtacccgttcgggtaaccctcgttccggttcccttccggtccacggtcccctttaccccgaccgttaaaccggggtccccttaacgttttccccccggg

SEQ ID NO: 363167 - DNA, 609 bp, Homo sapiens
  misc_feature: GZ8MTXP01AUVW7.44.86.H09.1.454.CMB.2.raw
  modified_base (385)..(385): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtactctattcgttggggctggactccggccacggcccccgaggggagggagtgggagtggagttggtgactatccattagtacgtggggacgtacgttactactccgtccgtccccctacaagcgtctcctacacctntttcggagggacaccgtcactcgaaccgtcttctaccctgtaaactcgaccctccgtcgaccgcccgcgacgacggtcgtttattcgtgtcgcggagtcgagtacttggtactttcaagttcgtaggtcggggaaccgtggttccctacccgttcgggtcctacgttcgttccttccgtcacggtcccttaccaccgttaacgggtcccttaacgtttccccgg

SEQ ID NO: 363168 - DNA, 661 bp, Homo sapiens
  misc_feature: GZ8MTXP01E0H2K.44.86.H09.1.454.CMB.2.raw
  modified_base (400)..(400): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctcgtaggtactttccatctagttctagtactctattcgttggggctggactccggcacgccccgaggggacgggagtggagtggtacttggtgacgactaccatttatacgttggggcgaccgtactactcctcccgtccccctacgaagcgtcgtctaccacctcttcggaggaccncgtcagtcgaaacccgtcttacctccccgtaggaaacctcgtacccgtcccgtacgaccccgccgggccggacctaccgggtcctttacttcggtgtcgaccgggacggcgtaacgccgttagggttaccttacgtaaacttcgtaacgggttcggggccgttcgggcccaaccccggttcgtaaaccgtccttcggttccttaccccttggacgtccctttaccccgaccggaaccggggtccccaacgtttcccccggg

SEQ ID NO: 363169 - DNA, 559 bp, Homo sapiens
  misc_feature: GZ8MTXP01DH6PE.44.86.H09.1.454.CMB.2.raw
  modified_base (286)..(286): a, c, t, g, unknown or other
  modified_base (309)..(309): a, c, t, g, unknown or other
  modified_base (340)..(340): a, c, t, g, unknown or other
  modified_base (380)..(380): a, c, t, g, unknown or other
  modified_base (425)..(425): a, c, t, g, unknown or other
  modified_base (437)..(437): a, c, t, g, unknown or other
  modified_base (524)..(524): a, c, t, g, unknown or other
tcagacagtatatacacgaccggtgctcgatttagtgctatagacttggggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagactctcctgtgtagcgtctggacttcaccttcaacngacatggcatgcacgtgggtccncaggctacgaggcaagggctgggaggtgggngactacgttatagtggtatgaataggaaaaattaataatntttatggtagattcggagaaacgggcctattcaacatctcaaganaacaatacgaanaacacaactatatacgtaagaaatagaaatacgacctaggaagtacggccgaaggacgaacggtcttgtcttacgtacgtgttacgngagaagagtcgggggctgggagtaacgttaagaag

SEQ ID NO: 363170 - DNA, 572 bp, Homo sapiens
  misc_feature: GZ8MTXP01AQ0O5.44.86.H09.1.454.CMB.2.raw
  modified_base (304)..(304): a, c, t, g, unknown or other
  modified_base (374)..(374): a, c, t, g, unknown or other
  modified_base (398)..(398): a, c, t, g, unknown or other
  modified_base (542)..(542): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggagttccatctagttctgatctattcgttgggctggactccggcacgccccgagggagggaatggagtggattggngacatactagttatacgtggggacacgttactacgtctccgtcccctacaagtcgtccgtctacaccgtnttcgaagggacacgtcatcgaccncttcctacctagaacctcgacctccgtcgacccgcgcgacacggttctttagtcgtggtgcgagcgagtcttggtctttacgaacttcgtaaggtcgggggtccgtcggttcctacccggttggtactcgttcgttcttcctcncgtctacccgacgaccggtccttcgtcccg

SEQ ID NO: 363171 - DNA, 628 bp, Homo sapiens
  misc_feature: GZ8MTXP01EHT7Y.44.86.H09.1.454.CMB.2.raw
  modified_base (281)..(281): a, c, t, g, unknown or other
  modified_base (309)..(309): a, c, t, g, unknown or other
tcagacagtatatacacgaccggtgctcgatttagtgctatagacttgggttgggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagactctcctgtgtagcgtctggattcaccttnaacagacatggcatgcacgtgggtcccnccaggctccgaggcaagggctgggagtgggtgacattatatggtatgataggaaaataaataatattatgtaagtattccggaggaacggcgtattccacatcctacaagagactaaagttacgaaagtaacaactaacttaagttaacttacgtaaagggtaaaatacgtaaaatacggtacccgttaaggaacgtaacgggacccggaaggggtaacccaacggggtaccttggttacccttaaacgtacgttggttaggccggaaagggtaagtagggttcgggggtccttacgggttagggtaacttaacggaag

SEQ ID NO: 363172 - DNA, 750 bp, Homo sapiens
  misc_feature: GZ8MTXP01BWEYC.44.86.H09.1.454.CMB.2.raw
tcagacagtatatacacgaccggtgctcgatttagtgctatagacttgggtttggggatgctttctgagagtcaaggacctcctgtgcaagaacactgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacttccatctagttctgtatctagttcgttgggctggacgtccggcgacgccccggagggacgggtagtggaggtggtagttggtagactactacctaagttacgtacgtcggggacgtacgttactactccgtcccgtcccctacgaagtcgtaccgtctaacctaaccgtgtttcggaacgggtacctaccgtaccgtaagtaccgtaaacccgttccttaccgtaccctaacgtaaaccgttccggtaacccgttccggtacccggacccggcccggacggtacccgtacgggttaccgttttacgtttcggggtagttcggtaccgggacggtcggtaaacgtcgttcgtttaccttacgtaaacgttcggttaacggtccggggtcggttccggcccgttaaccccggttgttaacccgtcgtttcccggttcccttcccgttcgggtaacccttcccgttaaccccggaaccggttaaaccccggggttccccttccgggttttccccccggg

SEQ ID NO: 363173 - DNA, 586 bp, Homo sapiens
  misc_feature: GZ8MTXP01A1SUG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatcattcgttggggctggatccggcagcccccgagggagggagtggagtggagttggtgacataccattatacgtggggcgacgttactactctccgtccccctcagagtcgtctcacctaattcgaggacacgtcatcgaaccgccttctcctacgaactcgaaccgtcccgtgacccgccgcggaccgaacgtccgtttagttcgtggttcggcgacggcgagtacgttggttctttacaattcggtacgtgggggcccgttagggcctaccccgttggtccacgttcgttccttcctcgagcccttccaccgacgggtcccttaagttcccccgg

SEQ ID NO: 363174 - DNA, 624 bp, Homo sapiens
  misc_feature: GZ8MTXP01AJQ4G.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccattcagttctgatcattcgttggggctggatccggcacggcccccgaggggacggggaagtgggagtggagttggtgacagttccatttacgtacgtgggggacgtacgttactactcctccggtaccccctcgaagtacgtcgtctaacacctgtttcgagggacacgtccatcgaaccgtcttcctacccgtagaaactcgaacctcccgtcgacccggccgcggacacggtcctttagttcggtgtcgcggacggcgtaaacgtcgtggttcctttactaaagttccgtagggtcggggtcgtcggttccgtacccgttggttccacgttcgttccttcctcgcgtccttcccgaccgttaacgggtcccttaacgttccccggg

SEQ ID NO: 363175 - DNA, 620 bp, Homo sapiens
  misc_feature: GZ8MTXP01AL38L.44.86.H09.1.454.CMB.2.raw
  modified_base (500)..(500): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatctattcgttgggctggactccggcacgcccccgaggggacgggaagtggaggtggtagttggtagacatacctagtttacgtaacgtcgggggtacgacgttacctaccttcgtacccggtccccctacgaagtacgtcgtcctaccacctcgtttcgacgggtacaccggtaccatcgaaaccgtcttcctccgtagaaactcgacctcgtcgaccgccgcgactacggtctttattcgtgtgcgtaggcgngtacgtggttctttcaacttcgtacggtcggggccgtggttccgtacccgttgggtcctcgttcgttccttacctccgtagtcccttaccgaccgttaacgggcccttaacgttccccgg

SEQ ID NO: 363176 - DNA, 607 bp, Homo sapiens
  misc_feature: GZ8MTXP01BECY2.44.86.H09.1.454.CMB.2.raw
  modified_base (399)..(399): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggtagtttccatctagttctgtatctattcgttggggtctggatccggcacgccccccgaggggacggggaagtgggaggtggtagttggtgtacatcctattagtacgtgggggcgtacgttacttactcctccgtccccctcaagcgtcgtctacacctgtttcgacggacncgtccagtacgacctcttctccctagaactcgtacctccgtcgaccgccgcgacacggtcgtttacttcgtagtgcgacggcgagtacgttggttctttcgtaacgttccgtaaggtcggggtccgtcggccgtaccccgttgtccgtacgttcgttccttcctcacgtcccttacccgacccgaaccgggtcccttaacgttccccg

SEQ ID NO: 363177 - DNA, 586 bp, Homo sapiens
  misc_feature: GZ8MTXP01EDZBQ.44.86.H09.1.454.CMB.2.raw
  modified_base (538)..(538): a, c, t, g, unknown or other
  modified_base (552)..(552): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggctggatccggctacggcccccgaggggacggggaagtgggaggtggagttggtggacatccattagtacgtggggcgtacgtactactctccgtcccctcaagagtcgtctacacctgtttcgagggacacgtccagtcgaaccgtcttctccctagaaactcgacctaccgtcgaccgccgacgacgtacggtcgtttactttcgtgtgcgaggcgagtacgttggttactttactaagttcgtacgtcggggtccgtggcctaccgttggtacctnttcgttcttccgtncgtccttccgaccgacggtcccgcgtttccccgg

SEQ ID NO: 363178 - DNA, 656 bp, Homo sapiens
  misc_feature: GZ8MTXP01AEVF2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacggccccgaggggaggggaagtggaggtggagttggtagactataccgtagttacgtacgtgggggaccgtacgttaccgtactcccgttcccgtcccccttacgaaggtacgtccgtctaaccaaccgtgtttacggaacgggtacaccgtaccagtacgaaccgtccttcctaccctagtaaactcgacctccggtacgcccgcggccgacgtacggttccgttttattccggtggtacggcggacggtcgtaagtcgttaggttcttacgtaacgttcgtacgggtcgggtccgtcggaccgtacccgttgggtcctacgttcgttccttcctcgtacgtccttacccgaccggttacggtccccttaacgtttccccgg

SEQ ID NO: 363179 - DNA, 597 bp, Homo sapiens
  misc_feature: GZ8MTXP01EZ329.44.86.H09.1.454.CMB.2.raw
  modified_base (314)..(314): a, c, t, g, unknown or other
  modified_base (450)..(450): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcgtggtccagccgtgggaggtccctgacgctctctgtgtagcgtctggacttcaccttcaacagacagtggacatgcacgtcgggtcccnccaggcctccgaggacgaaggggctgggaggtgggtgctacgttatagtggtatggataggtaaaataaataattattatagtagtagttcggagacgggcctattccacatcacgaagagtaacaagtacgaaanaacaactaacttagtactacgtaaggtaaaatgaaatacgcgtaggacgacgaccggaacgaccgaacggtcttacgtaccttaacgtacgtggttacggacggaggtaacggaggtcggggaccgttggttaggtaattaacgaag

SEQ ID NO: 363180 - DNA, 562 bp, Homo sapiens
  misc_feature: GZ8MTXP01CWV6L.44.86.H09.1.454.CMB.2.raw
  modified_base (352)..(352): a, c, t, g, unknown or other
  modified_base (364)..(364): a, c, t, g, unknown or other
  modified_base (453)..(453): a, c, t, g, unknown or other
  modified_base (505)..(505): a, c, t, g, unknown or other
  modified_base (553)..(553): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgccccgagggagggagtggagtggagttggtgacataccagttagtacgtgggcgacgtactactctccgtcccctcagngtctctcacctnttcgagggtacacgtccatcgaaccgtcttctcctagaactcgaccgtcgtcgccgccgcgacacgtcgtttacttcgtgtgcgagcgngacgtggttcttctaagtccgtagtcggggccgtggcctaccgttggtaccncgttcgttccttccgtctacggtccttaccgaccgttacgggtccccngttccccgg

SEQ ID NO: 363181 - DNA, 778 bp, Homo sapiens
  misc_feature: GZ8MTXP01DG9ZU.44.86.H09.1.454.CMB.2.raw
  modified_base (409)..(409): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcagcatctcctgcgagttgggagcggcctaccgaacgagggcggggtactaggtttgagttgttacaagtcgggtaaccagtacctaaacgttaccgaaacggaaaccaccgaccccccaaaagtcgtacctactaacgtttaccgactaaaccacctaaccgtttcccggccccttacggaaccggggttcccctcggaacccgtntttaccgacgacggtccctacccgtaaacggttcctcgggaccctaacccgttccgacccgtccccgtacccgtcggaccctacgtccgtaccggtcgggtacctacccggtaacggtccggttagggaaggtaacgttgggaacggtcgttagttaatttaacgttaccgtcgaacccgtaacggtaccttaagtccgaacgtaaccggctaaccggtccgtacgggtggggtttaagggggtttcgggggttcggttaccgggggaacggggaaccgggtaccggaacggttccggttaccgggtaacccgggttccggtaagggtacccgaccggttacccggtaacggttccccgttcccccggg

SEQ ID NO: 363182 - DNA, 610 bp, Homo sapiens
  misc_feature: GZ8MTXP01BOF4M.44.86.H09.1.454.CMB.2.raw
  modified_base (573)..(573): a, c, t, g, unknown or other
tcagacagtatatacacgaccggtgctcgatttagtgctatagacttgggtttgggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggctggactccggcacgccccgagggacgggagtggaggtggagttggtcgactactctattagtacgtggggacgtacgtactactcctccgtcccctacgaacgtcgtcgtcctacctactcgttcgacgggtacaccgtccaatcgaaccgtccttctccctagaactcgaccctccgtcgaccgccgtacgaccgtacggtaccgtttactttcgggtgtcggcggtacggcgtaacgtcgttgttcctttactaaagtctaggtcgggtccggtggccgtaccgttgtcctagttcgttccttcnccgtctcttcccacgacgtccgttaacgtttccccgg

SEQ ID NO: 363183 - DNA, 581 bp, Homo sapiens
  misc_feature: GZ8MTXP01DRDRX.44.86.H09.1.454.CMB.2.raw
  modified_base (306)..(306): a, c, t, g, unknown or other
  modified_base (503)..(503): a, c, t, g, unknown or other
  modified_base (553)..(553): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtgggtccncaggctccgaggcaaggggactgggagtggggtgcacttatagtggtatgaatggaaaagtaaattaagttattagtagtagtaatttccggaggaaagggtcccgtattccaccagttcctaccaaggaagaactaaacgttacgaaaagaaacaacacttaagttaacttcgtaagtaaatgaaatagcctaagngagccgaggacaacggcttgtacttacgtacgtgttcgcgagaaggtagngggggtactggttaggtaacttaagaag

SEQ ID NO: 363184 - DNA, 571 bp, Homo sapiens
  misc_feature: GZ8MTXP01B6Q4X.44.86.H09.1.454.CMB.2.raw
  modified_base (367)..(367): a, c, t, g, unknown or other
  modified_base (560)..(560): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacatccattatacgtgggggcgtacgtactactctccgtccccctcagacgtcgtctcacctntttcgagggacacgtccatcgaacccgtcttctccctagaaactgaccctccgtgacccgccgcggacacggtcgtttattcgtgtgtcgaggcgagtactggttcctttcaattctagtcggggccgtcggcctacccgttggtcctacgttcgttcttccttcgacgtccttacccaccgaacgggtcccncgtttccccgg

SEQ ID NO: 363185 - DNA, 771 bp, Homo sapiens
  misc_feature: GZ8MTXP01AN87N.44.86.H09.1.454.CMB.2.raw
  modified_base (226)..(226): a, c, t, g, unknown or other
tcagacagtatatacacgaccggtgctcgatttagtgctatagacttgggtttggagatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctntgtagttccatcagttctgatcattcgtggctgactccgcgacgccccgagggagggaagtggagtggatggagacatcctagttagtacgtggggaccgtacgtactacgtcctccccgtacctacgaacgtacgtccgttacctacctaaccgtacgtttcgggaacgggtacctaccgtcctaaacgtaccgggtaacccttccgtttaccctacccgtaacgaaaccgttccgtaaccgtccccggttacggaccccggtcccggacccgtaaccggtacccggtttacccgttttaacggttttcgtgggtttaccggacgggtaacggggtaccgtaacgtaccgggtttcggtttaccttttaccgtaaaacggtttccgttaaacggggtttcccggggggtcccgttacgggtcccccggtttaaacccgtacggggtttccccttacgttcccgggttaacccttccccgttacgtaaccccgtttcccgtacccccgaacccggttaaaccggggcccccgttttaaccccggg

SEQ ID NO: 363186 - DNA, 627 bp, Homo sapiens
  misc_feature: GZ8MTXP01B4LSI.44.86.H09.1.454.CMB.2.raw
  modified_base (583)..(583): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgctactgtctcgtggtatttccatctagttctgtatctattcgttggggctggagtccggcacgccccgagggaggagtggagtggagttggtgacatcctattagtacgtgggctacgtactactctccgtccctacagtagtccgtctacacctgtttcgacgggactacgtcctagtacgaacccgtcttctaccctagtaacctcgacccgtccgtacgacccgaccgcgacgtccggttaccgtttattcggtagttcggcggtacgggtcgtacgtacgttcgtttacgttactaacgttcgtacggtcgggggtccgtcggttccgtaccgttggtcctacgttcggttccttcccgttnaccgtccttacccgaccgaacgggtccccttaacggtttccccg

SEQ ID NO: 363187 - DNA, 739 bp, Homo sapiens
  misc_feature: GZ8MTXP01BYXPI.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctcgtggtatttcatctagttctgtatctagttcgttgggtctggacgtccggcacgccccgaggggagggaagtggaggtggattggtacgactatcctatttagtacgtgggccgtacgtactactcctacccgtccccctacgaacggtcgtccgtcctaaccaacccgttaagtttacggaacggggtaccaccggtccgaacttacgaaacccgttccttaccctacccgttacggtaaaccttccgtaacccgtccgttaccggacccggacccggtaccgggtaaccctacgggttacccgtttttagtttaccgggtgttcgggccggagggtaccgtacgttaccgttggtttacctttacgaaacgttcggtaacggttccgggggtaacccggtcggacccgttaaccccggttggttacccgtaccgttcggttcccttacccgttcgaaccgttcccgttacccgaccccggttaaacgggtccccttaacggttttcccccggg

SEQ ID NO: 363188 - DNA, 641 bp, Homo sapiens
  misc_feature: GZ8MTXP01BGHLS.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctcgtggtactttccatctagttctgatctattcgttggggctggactccggcacgccccgaggggacggggaagtgggagtggtagttggtagactataccgtagttacgtacggtcgggggacgtacgttacctaccttccgtcccgtccccctacgaacgtcgtcgtctaccacctaagtttcggagggtaccaccgtaccacgtacgtaacccgtcttcctaccctagaaacctcgaccctccgtacgaccgccgacgacgtaccggttctttacgttcggtgtcgcgaggcgacgtacgttcggttacttgtaacttcgtacggtcggggcgtcggcctacccgttggtcctacgttcgttccttccgtcgacgtcccttaccgaccgttaaccggtcccgttcgtttccccggg

SEQ ID NO: 363189 - DNA, 613 bp, Homo sapiens
  misc_feature: GZ8MTXP01DRCK9.44.86.H09.1.454.CMB.2.raw
  modified_base (263)..(263): a, c, t, g, unknown or other
  modified_base (265)..(265): a, c, t, g, unknown or other
  modified_base (289)..(289): a, c, t, g, unknown or other
tcagacagtatatacacgaccggtgctcgatttagtgctatagacttgggtttggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcacagtgtctatttcccatgctcaacagancngccaacgccccagacactaattanagatataactatagacagtcctgacacctcgcccgtctctcaccggcctcctcgtacggggaaccaaaacgcccgtccctcgtaccctttcgacgtcgccgcacgccgtagacggatggagtcgtagaacttattacgtgtccttgcttccgtacttaagttaggtgttacgtcgggtagtcgggttcgggacggtacggtaccgaagtccgtcggtaacccgtacgttacgggtccacggtaccccgtaacggttcccgttccggttccccccgtggtaccctcccgttccctcccggttcccccgtccccttcgttaacccg

SEQ ID NO: 363190 - DNA, 602 bp, Homo sapiens
  misc_feature: GZ8MTXP01CLPUR.44.86.H09.1.454.CMB.2.raw
  modified_base (347)..(347): a, c, t, g, unknown or other
  modified_base (365)..(365): a, c, t, g, unknown or other
  modified_base (400)..(400): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggatccggcagcccccagggacggggaatggagtggattggtgacatccattatactgggggcacgtactactctccgtccccctnaagacgtcgtctacaccngtttcgagggaccacgtccatcgaaaccgctttcnccctagaaacctgaacccgtccgtcgacccgccgacggacacggcctttagttcgtagttggcgaggcgagtacgtggttcttcgtaaattcgtaacgttcggggcccgtaggcccgtacccgttcgggtctaccgttcggttccttcccttctaaccggtcctttacccgaccgaaccggggtccccaacgtttcccccgg

SEQ ID NO: 363191 - DNA, 559 bp, Homo sapiens
  misc_feature: GZ8MTXP01EUTYC.44.86.H09.1.454.CMB.2.raw
  modified_base (404)..(404): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggattccatctagttctgatcattcgtgggctggatccggcacggccccgaggggagggaagtggagtggagttggtgacagtacctattatacgtggggacgtacgttactactcctccgtccccctacgaagacgtcgtctacacctgtttcgagggacacgtccatacgaaccncttctcctagaactcgacctccgtcgaccgccgcgacacggtctttattcgtgtgcgagcgagcttggtcttctatctagtcggggcgtgccacccgttggtccacttcgttccttctcacgtccttacccacgacgggtcccttaacgtcccgg

SEQ ID NO: 363192 - DNA, 649 bp, Homo sapiens
  misc_feature: GZ8MTXP01AUZQQ.44.86.H09.1.454.CMB.2.raw
  modified_base (314)..(314): a, c, t, g, unknown or other
tcagacagtatatacacgaccggtgctcgatttagtgctatagacttgggttggggagctctggggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtggggggagcgtggtccagccgtggggacgtccctgacgctctcctgtgtagcgtctggtattcaccttcaacagacatcggcatgcacgtcgggtcccncgaggctccgaggcgagggactgggagtgggtgactacttatacgttggtatgaactggaaaaattaataatattagtgtagagtttccggagaaacgggtccgtattaccaccgtatccgtaccaagtacgaactaagttacgaaagaacaacaactataatacgtaaggtaaagttagaaatacgtaccgtaggaacgacggaccggaacgggccgaaccggtcgttacggtacccttaacgttaaaccggttcggttaaggcccggggttaaacgtaaggggtaaggtcggggggtaacccttcgggggaagggttaaccttaacgtaaagg

SEQ ID NO: 363193 - DNA, 559 bp, Homo sapiens
  misc_feature: GZ8MTXP01EY7KC.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgagggacggggaagtggagtggattggtgacatccattatacgtgggcgacgtactactctccgtcccctcagagtcgtctcaccntttcgagggacacggtccatcgaaccgcttctccctagaaactcgacctccgtgacccgccgcgacacggtccgtttattcgtgtcgcgaggcgagacgtggttctttcaagttctagtggggccgtggccaccgttggtcacgttcgttccttcctcagcctttccaccgaacgggtccccttaagttccccgg

SEQ ID NO: 363194 - DNA, 590 bp, Homo sapiens
  misc_feature: GZ8MTXP01A0OBC.44.86.H09.1.454.CMB.2.raw
  modified_base (313)..(313): a, c, t, g, unknown or other
  modified_base (469)..(469): a, c, t, g, unknown or other
  modified_base (474)..(474): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggaggcgtggtccagccgtggggagtccctgagactctcctgtgtagcgtctggattccaccttcaacagacatggcatgcacgtcggggtcccnccgaggcctacccgagggccgaagggggactgggaggtggggtgctacgttatacgttggtatgagtaggtaaaaattaaataattatttagtagttagtagttcgtaggaaacgggtcctacttacactatcctacaagactaacaatacgaaanaacanaactatatcgtaggaaatagaatagccgtagagacgaccggagaccgcggtcttgtaccttagtaccgttgacgcgaaggaaggtaggtcggggcctgggttagaagttaacgaag

SEQ ID NO: 363195 - DNA, 602 bp, Homo sapiens
  misc_feature: GZ8MTXP01DGQY0.44.86.H09.1.454.CMB.2.raw
  modified_base (366)..(366): a, c, t, g, unknown or other
  modified_base (449)..(449): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggacgtggtgacggccgttcgggaacctgtctctcatctgcactgtctcgtggtatttccatctagttctgatctattcgttgggctggactccggcacggccccgaggggagggaatggagtggtagttggtgactatactagtttagtacggtggggacgtacgttactactcctccgtcccctnaagtcgtcgtctacactgttcgacggtacacgtccatacgacctcttctacctagaactcgacctcgtacgaccgtcgcgacncgttaccgtttattcgtgtggcgacggcgagtacgttggttaccttcgtaagttcgtaggtccggggaaccgtcggcccgtaccgttggtacctcgttcgttccttccgtcacggtcttcccgaccgttaaccgggtccttaacgttccccgg

SEQ ID NO: 363196 - DNA, 638 bp, Homo sapiens
  misc_feature: GZ8MTXP01B2S6C.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggactccggcacgccccgagggacggggagtgggagtggagttggtgacattcctattacgtacgtgggggtaccgtacggttacctaccgtcctcccgtacccccctacgaagacgttccgtcctaccaaccctgtttaccgggaacggggtacctaccggtacctaacgtcgaaccccgtcctttcctaccccgtagaaacctcgaccctccggtcgacccgccgcgacctcggttcctttattcgtgttgacggacggtcgagtacgttggttactttcgaagttcctaggtccgggcgtggccctaccgttggtccacgttcgttccttccgtcagtcccttaccgaccgttacgggcccttcgttccccgg

SEQ ID NO: 363197 - DNA, 827 bp, Homo sapiens
  misc_feature: GZ8MTXP01ANOUF.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgcactgtctctggtactttccatctagttctgatctattcgttggggctggactccggcacgccccgaggggagggaagtggaggtggagttggtagactataccgtaattacgtacggtgggggtacgtacgttacctacctccgtcccggtcccccctacgaacggtacgtccgtccgttaacccaacccgttaagtttaccgggaacggggtaacccaccgttaccgaacgttaccggtaaaccccgtccctttacccgtacccccgttaacgtaaaaccgttcccgtaaaccccgttcccgggtacggaacccccggtaccgggaccccgggtaaccgtaccccggggttaccgttttttaaccgtttaccggggttacgggtttccggggaccgggtaacggggtaccggttaaacccgggttacgtttaccggggtttaccgttttaaccgtaaaacgttcccggttaagggttcccggggggtaacccgtttccggggacccctacccgggttgggtaccctaccggttcgttcccttcccgtaaccgtacgttcccttacccccgaacgggaaccccggtccccgttaacggtttcccccggg

SEQ ID NO: 363198 - DNA, 593 bp, Homo sapiens
  misc_feature: GZ8MTXP01BO6Q1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttgggctggactccggcacgcccccgagggaggggaagtggagtggagttggtgactataccattagtacgtggggcgtacgtactactctccgtcccctacacgtacgtccgtctaccacctgtttcgagggacacgtccatcgaacccgtcttctccctagaaactcgacctccgtcgaccgccgcgacgtacggtctttagttcgtgtcggcgacggcgtacgacgttcggtacctttcgaaattcgttaggtcggggccgttcggcctacccgttggtccacgttcgttccttcctcacgtccttccgaccgacggtcccgttaacgttccccgg

SEQ ID NO: 363199 - DNA, 527 bp, Homo sapiens
  misc_feature: GZ8MTXP01BZDKF.44.86.H09.1.454.CMB.2.raw
  modified_base (309)..(309): a, c, t, g, unknown or other
  modified_base (414)..(414): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggaggcgtggtccagccgtgggacgtccctgagctctcctgtgtagcgtctggattcaccttcaacagacatggcatgcacgtgggtcccnccaggcctccgaggcgaaggggctgggaggtgggtgctacttatagtggtatgatggaaaataataatattatgtagattcggagaaggccatcacatcacaganacaatcgaagaacacactatatctaggaatagaatgctagagtagcgagcgaacgcttgtcttagtacgtgttcgcgagaaggtgtggggctcggttgtaacgttaacgtaag

SEQ ID NO: 363200 - DNA, 688 bp, Homo sapiens
  misc_feature: GZ8MTXP01CJR3A.44.86.H09.1.454.CMB.2.raw
  modified_base (186)..(186): a, c, t, g, unknown or other
  modified_base (287)..(287): a, c, t, g, unknown or other
  modified_base (303)..(303): a, c, t, g, unknown or other
  modified_base (336)..(336): a, c, t, g, unknown or other
  modified_base (376)..(376): a, c, t, g, unknown or other
  modified_base (431)..(431): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtntccagtgtcgaggtgaagcgtggtggagtcggtgggggagcggtggtccgagcccgtaggggacggtcccctaggacgtactctccgtggtgtacgcgttntggtacttccaccttnaaacagacagtggcatcgctacgtcgggtcccnccgaggcctaccgaggacgaagggtcgtgggagttggggngacctagtttagtaagtgggtaatggtaataggtaaaaaaagttaataaagtttntttaagtaacgttaaggtacttaccgggtaggaaacggtcccgtattacccaactataccgtaccgaaagtaacgaactaagttaaccggaaacaaacactaaccttaatacgttaacgttaaagaaatgaaacttcggacgtaagaccgtaggaccggaacggcctaacgggtcttacggttaccaacgttacgtggttagaccgggaggtaaagggtcggttcggggtccttaaggttactaagaaccgggtaag

SEQ ID NO: 363201 - DNA, 716 bp, Homo sapiens
  misc_feature: GZ8MTXP01BG4AR.44.86.H09.1.454.CMB.2.raw
  modified_base (653)..(653): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggtactttccatctagttctgtactctattcgttggggctggacgtccggcgaccggacccccgaagggggacgggaagtggtaggtggtaagttggtaggactatccgtattacgtaacggtggggaccgtacggttactactccgtccgtccccctacgtaacgtcgtccgtctaaccacctaagtttcggaacgggacctacgtaccagtacgtaaacccgtcctttaccgtacccctaaggtaaaccctaccggtaacccgttcccgggtaccgacccggcccggaccggtaccgtaccgggtttacgtttacgtttcggggtcggttacggacggtacggtacggtacgttaccgttagggttactttaacgtacgttacgttcgggtcggggtccggtcgttacccgtcccgttcgggtacncttcggttcttaccttcaggtccccttaccgaccggttaacgggtcccttccggtttccccgg

SEQ ID NO: 363202 - DNA, 615 bp, Homo sapiens
  misc_feature: GZ8MTXP01D363Q.44.86.H09.1.454.CMB.2.raw
  modified_base (491)..(491): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgactctattcgttggggctggatccggcacgccccgaggggagggaatggagtggagttggtgactactcctaatttagtacgtggggacgtacgttactactccgtccgtccccctacgaagtcgtactcctaacctacctaagtttcgacgggaactacgtccagtcgtaaacccgtcttcctacctagaactcgaccctcgtcgaccgccgcgacacggtctttattcgtgtgcgacggngtacgcgttggtcttcaagttctagggtcggggccgttcggcctacccgttggtcctaacgttcgttccttaccctgtaacgtcctttacccgaccgacgggtccccttaaggtttcccccggg

SEQ ID NO: 363203 - DNA, 594 bp, Homo sapiens
  misc_feature: GZ8MTXP01AC5FL.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaacgtgggagtggattggtgacatccattagtacgtggggacgtacgtactactctccgtccccctacagtagtcgtctacacctgtttcgagggacacgtcatcgaacccgctttcaccctagaactcgaccctcgtacgaccgccgccggactacggtcgtttattcggtgtggcgaggcgagacgtggttcttacgtaactcgtaggtcgggggccgttgggacctacccggttggtcctacgttcgttcttcccttcgacgtcccttacccgaccgaaccggggtccccttaagtttccccggg

SEQ ID NO: 363204 - DNA, 606 bp, Homo sapiens
  misc_feature: GZ8MTXP01AZH4V.44.86.H09.1.454.CMB.2.raw
  modified_base (359)..(359): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggactccggcacggaccccgaggggagggaagtgggagtggtagtggtgacataccgattagtcgtgggacgtacgtactactcctccgtccccctanacgtacgtctctaccactgttcgagggactaccgtcacgtacgtaacccgcttctcctagaaactcgaacctccggtacgaccgcccgcgaccgtacggtcctttacgttcggtcgtgacgacggcgacgtacgttggttacttctaagttcgtacggtcggggtcgtcggttcgtacccgttggtacctcgttcgttcgttcctaacgtacgtccttccgaccggaaccgtccgttaacgtccccg

SEQ ID NO: 363205 - DNA, 596 bp, Homo sapiens
  misc_feature: GZ8MTXP01ANL4P.44.86.H09.1.454.CMB.2.raw
  modified_base (313)..(313): a, c, t, g, unknown or other
  modified_base (566)..(566): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacgtccctgagactctctgtgtagcgtctggattccaccttcaaacagacatggcatcgcacgtcgggtcccncaggcctccgaggcgaagggctgggagtgggtgctaacgtttatacgtggtatgaataggtaaaataaactaattattaagtcgtagacgtttccggaggtaaacgggcctaattccaacctagtcctaccgaagtaacgaaccaaagttacgaaacgaaactacgaacttaagtactacgtaaggaaattgaaagtcgcctaggacgcgaccgagacgaacggtcttacgtacttacgtagtcgagcgaggngtagtcggggtacctggttaggaattgaag

SEQ ID NO: 363206 - DNA, 628 bp, Homo sapiens
  misc_feature: GZ8MTXP01CA1PC.44.86.H09.1.454.CMB.2.raw
  modified_base (314)..(314): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctgttgcttcttttaagaggtgtccagtgtcaggtgaagcgtggtggagtcgtgggggagcggtggtccagccgtggggacgtccctgagactctcgtgtgtagcgtctggacttcaccttcaacagacagtggcatgcacgtcgggtccncaggcctccgaggcgaagggcgtgggaggtgggtgactagttatagtggtatagagtaggaaaagttaaataatattacgtagtagtacgttacgggtaggaaacgggtcctaattccaacctacgttcctaccaaggacgtaactaacgttaacgaaacgaacaactaacttaagtagtacgttaaggaaacttaggaaatacgacgtaggacgacgtccggacgaaccgcggtcttggtacccttacgtacgtcgggttagcggagtaagggcggttaagggggccttagggttaggtaacttaacggtaag

SEQ ID NO: 363207 - DNA, 599 bp, Homo sapiens
  misc_feature: GZ8MTXP01CYQ6M.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgaggggagggaagtggagtggattggtgacatccattagtacgtggggcgtacgtactactctctcgtcctcaagtcgtcgtctcncctagtttcgacgggacacgtcatcgaaccgtcttcctcctagaaacctgacccgtccgtcgacccgcgcgacgtacggtccgtttagttcgtgtcgcggtacggcgacgtacgttggttctttacgaattcgtacggtcgggggtccgttggcccttaccggttcggtccttaccgttcggttccctcctcgtaacgtcccttacccgaaccggtaaccgggttccctaacccgg

SEQ ID NO: 363208 - DNA, 838 bp, Homo sapiens
  misc_feature: GZ8MTXP01EGHK9.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacccttgtctctcatctgcactgtctctggtatttccatcagttctgatctattcgttgggctggatccggcacgccccgaggggagggagtggaggtcggagttggtgtaacattaccaagtttaacgtacggtagggggtaccgtaaccggttaacctaaccgttcccgtaccccgttcccccccgtacgtaaaacggtacgttcccggttaccctaaccctaacccgttaacgtttttacggggaaaccggggtaaccctaacccgggttaccctaacggtttaccggaaaaccccgggttccctttcccttaccccgttaacggtaaaaacccgttccggtaaccccgtttaccccgggttaccggtaaacccccgggtcccgggaccccggggtaaaccccgtaaccggggtttcccgttttttaacgttttaccggggttcggtttacgggtaccggacggggtaccgtacggtaaacccgtttgggttaaccctttttacgaacgtttaccgttaacggtttcgggggccgtttcgggccgtaaccccggttggtccctaaccgttcggttccttacccggtctaccggtcctttacccgaccggttaccggtcccttaacggtttccccgg

SEQ ID NO: 363209 - DNA, 592 bp, Homo sapiens
  misc_feature: GZ8MTXP01ET5UN.44.86.H09.1.454.CMB.2.raw
  modified_base (383)..(383): a, c, t, g, unknown or other
  modified_base (506)..(506): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacggcccccgaggggacggggaagtgggagtggtagttggtgacatccattagtacgtgggggcgacggttactactctccgtccccctactaagagtcgtctaccacctntttcgagggtacacgtaccatcgaacccgtcttcctccctagaacctcgaccctaccgtcgacccgccgacgacgtacggtccgtttattccggtgtcgcgacggcgagtacgtggttacttnaattcgtagcggggtcctggcctaccgttggtctcgttcgttccttcctcacgtccttccaccgacgggtcccttaagttccccgg

SEQ ID NO: 363210 - DNA, 553 bp, Homo sapiens
  misc_feature: GZ8MTXP01BLD8S.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccgagggagggaatggagtggatggtgacatctattagtacgtggggcgacgtactacgtctccgtcccctacaagagtccgtctacaacctnttacgagggactacgtccatcgaaccgtctctccctagaaactcgacctcgtgacccgcgcgacacggtcgtttattcgtgtgcgagcgaagctggtctttcaatcgtagtggggccgtggccacccgttgtctacgttcgttccttcctcacgccttaccgaccaacgggtcccttaattccccgg

SEQ ID NO: 363211 - DNA, 611 bp, Homo sapiens
  misc_feature: GZ8MTXP01B8F2U.44.86.H09.1.454.CMB.2.raw
  modified_base (352)..(352): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgctactgtctctggtatttccatcagttctgatctattcgttgggctggatccggcacgccccgagggagggaatggagtggatggtgacatacattataacgtgggcgaacgtactaactctccgtacccccctaanaagtacgtcctactaacaactaagttacgaacggaccacgtactactacgtaacctcttacctacctacgtaaactcgtaccctaccgtacgaccgaccgacgtacgtacggttactttatttacggttacgtgacgacggacgacgtacgtcgttacttactaactacgtacggtcggtcggtcggccgtaccgttcgtacgtacttcgttcttcctaactacgtaacctacgtaccgaccgtaaccgttaacgtccg

SEQ ID NO: 363212 - DNA, 590 bp, Homo sapiens
  misc_feature: GZ8MTXP01EG87B.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggcctttcgggaaccctgtctctcatctgcactgtctctggatttccatcagttctgatcattcgttgggctggatccggcacgcccccgagggaggggaatgggagtggagttggtgacagtccatttagtacgtggggcgacgttactactcctccgtccccctcaagtagtcgtctaccacctgtttcgagggaccacgtccagtcgaaaccgtcttctcccttagaaacctcgaacccttccggtcgacccgccggcgaccgaccggtaccgttttactttcgtgttcgccgaggcgagacttggtctttctaatcgtagtggggccgtggcctacccgttggtcacgttcgttcttacctcagtcccttaccaccgaacggtcccttgttccccgg

SEQ ID NO: 363213 - DNA, 594 bp, Homo sapiens
  misc_feature: GZ8MTXP01DZR2I.44.86.H09.1.454.CMB.2.raw
  modified_base (312)..(312): a, c, t, g, unknown or other
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggatttccatcagttctgtatcattcttggggctggatccggcagccccagggagggaagtggagtggatggtgacatccattanacgtgggcgacgtactactctccgtcccctcaagagtcgtctcacctnttacgagggacacgtcatcgaaacccgtcttctccctagaaactgaacctccgtgaccgccgcggaccacggtccgtttagtttcgtcggttacgcggtagcggagtaccgttggttactttcgaaattccgtagtcgggggtccttcgggactaccccgttgggtacctacgttcggttccttccctcgacgtcctttacccgaccgaacggggtccccaagtttcccccggg

SEQ ID NO: 363214 - DNA, 680 bp, Homo sapiens
  misc_feature: GZ8MTXP01D5BBS.44.86.H09.1.454.CMB.2.raw
  modified_base (314)..(314): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagcctgggacgtccctgagctctcctgtgtagcgtctggattcaccttcaacagacagtggcagtgcctacgtcggggtcccnccgagggccctaccgaagggtccgaaagggggtcctgggggaggtgggggtcgactaacgtttagtacgttgggtataggagtacgggtaaaaaagttaaataagttatttacgtaggttaagtacgtttccgggagggtaacgggtaccgtattaccaacctattaccgtacccgaagtacgaactaaacgttacggaaaacaaccaactaacttaataacttacgtaaggtaaaatagtaaacgtacgtaccgtagaacggtacgacccggaaggaccgaacggtcttacggttaccttacgtaacgttcggttagcggaaggtaacggtaggtgggggtcctggttaggtaacttaacgtaag

SEQ ID NO: 363215 - DNA, 597 bp, Homo sapiens
  misc_feature: GZ8MTXP01EOV5F.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacgcccccgaggggacggggaatggagtggagttggtgacatccattatacgtgggcgacgttactactctccgtccccctcaagcgtctcgtacactntttcgacgggacacgtccatcgaacccgtcttctacctagaaacctcgacctccgtacgacccgtccgcgacctacggtcgtttattcgtgtgtcgaggcgagtaccgttggttctttacgaacgttcgtaggtcggggtccgtcggttcctcccgttggtccctacgttcgttccttccgtctacgtcccttcccaccgttaacgggtcccttaacgtttccccgg

SEQ ID NO: 363216 - DNA, 602 bp, Homo sapiens
  misc_feature: GZ8MTXP01EMS1H.44.86.H09.1.454.CMB.2.raw
  modified_base (372)..(372): a, c, t, g, unknown or other
tcagacagtatatacacgaccggtgctcgatttagtgctatagactttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaagtggagtggagttggtgacagtccattagtacgtggggcgacgtactactctccgtccccctcaagagtcgtctacacctntttcgagggacacgtaccatgtaaccgcttctccctagaaactgaccctccgtcgacccgccgcggacacggtccgtttatttcgtgttgcgtaggccgagacgttggtctttactaattcctaagtcgggggtccgtggaccctcccgttgggtcctacgttcggttccttcccgttcacggtccctttccccgaaccggaaccggggtccccttaagtttcccccggg

SEQ ID NO: 363217 - DNA, 643 bp, Homo sapiens
  misc_feature: GZ8MTXP01CC2TV.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgtatctatttcgttggggctggactccggctacggcccccgaggggacgggaagtgggaggtggtagttgggtgactatcctatttagtacgtgggggcgtacgttactactcctccgtccccctacacgtgtcgtctaaccactgtttcgagggcacgtccatcgtaaccgtcttctcctagaactcgacccgtccgtcgccgtccgccggacgtacggtcctttacgtttcggtaggttcgcggtacggcgacgtacgttggttacctttacgaacttcgtacggttcgggggaacccgttgggaccctacccggttggttaccctacgttcggttcccttcgtcctacgtccttaccccgaccgaaccgggtccccgaacgtttcccccggg

SEQ ID NO: 363218 - DNA, 605 bp, Homo sapiens
  misc_feature: GZ8MTXP01D4RV7.44.86.H09.1.454.CMB.2.raw
  modified_base (353)..(353): a, c, t, g, unknown or other
  modified_base (369)..(369): a, c, t, g, unknown or other
  modified_base (402)..(402): a, c, t, g, unknown or other
  modified_base (451)..(451): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctctggtatttccatcagttctgtatcattcgttgggctggactccggcacgcccccgagggagggaatggagtggattggtggactatccagtttagtacgtggggcgacgtactactctccgtccccncaagatcgtctcactnttcgaggacacgtcatgaaaccgtcttctccanaaactcgaccctcgtcgaccgccgacgacctacggtcgtttattcggtntggccgtaggcgtagacgtcggttcctttacgaattcgtcggtgggggtcccggtgggaaccctcccggttggttaccgtacgttccggttccttccctcgtacgtccctttacccggacccgaaacgggtccccgttaacgttttcccccggg

SEQ ID NO: 363219 - DNA, 590 bp, Homo sapiens
  misc_feature: GZ8MTXP01DNTJY.44.86.H09.1.454.CMB.2.raw
  modified_base (502)..(502): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgttgggctggactccggcacgccccgagggacgggaatggagtggattggtgacagtccatttacgtacgtgggcgtacgttactactctcccgtccccacaagtacgtcgtctacacctgtttcgagggacacgtccatcgaacccgcttcctacctacgaaactcgaaccgtccgtcgaaccgcccgacgacgtaacggtccgttttaacttcggtacgtcgcgacggcgagtacctgggttacctttnaaatcgtacgtcggggtcctggccgtacccgttggtccattcgttccttccgtcacgtcttccgacgacggtccgaacgtttcccggg

SEQ ID NO: 363220 - DNA, 677 bp, Homo sapiens
  misc_feature: GZ8MTXP01AWAZK.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggccaggactggtgacggccttcggaaccctgtctctcatctgcactgtctctggatttccatcagttctgatctattcgtgggctggactccggccacggcccccgaaggggaggggaaacgtgggacgtgggtagttggtagactagtccattagtacgtggggacgacgtactactctccgtcccctcagagtcgtctcacngttcgaggtacacgtccatacgaaccgtccttctacccgtacgaaactcggaaccctccggtcgaccgtccggacggaccgtacggtccgttttacgtttcggttcggtggtcggacggtacggtaacgtacgttacgggttaccttttacgtaaacttcggttacggttcgggggtccccggttcgggttacccggtaccgttcggggttaaccctacgttcggttcccttaccctcgtaaccggtcccttttaccccgaacccggttaaccgggtccccgttaaccggtttccccgggg

SEQ ID NO: 363221 - DNA, 539 bp, Homo sapiens
  misc_feature: GZ8MTXP01D7SP1.44.86.H09.1.454.CMB.2.raw
  modified_base (308)..(308): a, c, t, g, unknown or other
  modified_base (376)..(376): a, c, t, g, unknown or other
  modified_base (380)..(380): a, c, t, g, unknown or other
  modified_base (392)..(392): a, c, t, g, unknown or other
  modified_base (414)..(414): a, c, t, g, unknown or other
  modified_base (424)..(424): a, c, t, g, unknown or other
  modified_base (442)..(442): a, c, t, g, unknown or other
  modified_base (444)..(444): a, c, t, g, unknown or other
  modified_base (497)..(497): a, c, t, g, unknown or other
tcagacagtatatacacgaccggtgctcgatttagtgctatagacttggggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtggggggagcgtggtccagcctggggaggtccctgagctctcctgtgtagcgtctggattcaccttcaacagacatggcatgcactgggtccnccaggctccaaggcaaggggactgggagtgggtgcacttatactggtatgataggaaaataaataatnttangtacgatttcgngaagggcattcacatctcaganacatacaaanaacacatatatatagaananatagactagagacgacgacggacgaacggtcgttcgtacttacgtactgttgngaggaaggaggtgggtcggtcggttaggtaagttaacgtaag

SEQ ID NO: 363222 - DNA, 566 bp, Homo sapiens
  misc_feature: GZ8MTXP01BT9Y9.44.86.H09.1.454.CMB.2.raw
  modified_base (262)..(262): a, c, t, g, unknown or other
  modified_base (315)..(315): a, c, t, g, unknown or other
  modified_base (330)..(330): a, c, t, g, unknown or other
  modified_base (541)..(541): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgctactgtctcgtggtatttccatcagttctgatcattcgttgggnttggatcggcagccccgagggaggatggagtggagtgtgacatctatatacgnggcgtacgtactacnctccgtccccctacgaagagtccgtactaccacctaacgtttgaacggtaaccaccgtccaagtcggaaaccctcttactccccttagaaactggaccctaccgtacgacccggcgaccggtaacacgggtacctttatttcgtagtgacgaggcgagacgtgttccttataatgtagtcggcgtcgctacgttgtactcttcgttcttcnctgtctccaccgacgtccgcgtccg

SEQ ID NO: 363223 - DNA, 611 bp, Homo sapiens
  misc_feature: GZ8MTXP01CYDD5.44.86.H09.1.454.CMB.2.raw
  modified_base (599)..(599): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttcctgatctagttcgttggggctggactccggccgacggtcccccgagggggacgggaagtggaggtggagttcggtgacgactccgagttatacgtggggcgtacgtacgtactctccgtcccctacgaagagtccgtctaccactcgttcggacggacacgtaccagtacgaacccgtcttcctacccgtagaaactcgacccgtcgtaccgaccgtccgcggactacggtccgtttattcggtcgtcgtcgaggtctaagcttgggtctttctaattcgtagcgggtccgtggttctcccgttgtaccgacgttcgttcgttccctgacgtccttccgaccgttacggggtcccncgtttccccggg

SEQ ID NO: 363224 - DNA, 542 bp, Homo sapiens
  misc_feature: GZ8MTXP02JNUPW.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccccctcaagagtcgtctcaccntttcgagggacacgtccatgaaccgcttctccctgaaactgacctccgtcgaccgccgcgacacggtccgtttatttctgtgcgaggcgagactggtctttcaattcgtagtcgggggccgtggccacccgtggtcactcgtctcctcacgtccttccacctaacgggcccagttccccgg

SEQ ID NO: 363225 - DNA, 560 bp, Homo sapiens
  misc_feature: GZ8MTXP02JKTGB.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtccccctcaagagtcgtctcaccntttcgagggacacgtccatgaaccgtcttctccctagaaactcgacctccgtcgacccgccgcggacacggtccgtttacttcgtgtgcgtaggcgacgacgttggtctttcaagttcctagtcggggccgttggccacccgtggtcaccgtcgtcctcctcacgtccttccaccgtaacgggccctacgttcccgg

SEQ ID NO: 363226 - DNA, 538 bp, Homo sapiens
  misc_feature: GZ8MTXP02HI4M0.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacagtccattatactggggcgacgtactactctccgtcccctcaagagtcgtctcaccntttcgagggacacgtccatcgaaaccgcttctccctgaaactgaccctccgtcgaccgccgcggacacggccgtttatttctgttgcgtaggcgagactggtctttcgaatcgtatggggccgtggcacccgtggtcactcgtctcctcgagcttccacctaacggcccagtcccgg

SEQ ID NO: 363227 - DNA, 545 bp, Homo sapiens
  misc_feature: GZ8MTXP02GI16L.44.86.H09.1.454.CMB.2.raw
  modified_base (362)..(362): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggaggggaatggagtggattggtgacatccattatactggggcgacgtactactctccgtccccctcaagagtcgtctcaccntttcgagggacacgtccatgaaaccgcttctccctgaaactgaccctccgtgacccgccgcggacacggtccgtttattctgtgcgaggcgagactggtctttcaatctagtcggggccgtggcaccctggtccacgtcgtcctcctcacgcttcccaccgaaacgggcccctaagttcccgg

SEQ ID NO: 363228 - DNA, 540 bp, Homo sapiens
  misc_feature: GZ8MTXP02FR60X.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgagggaggggaatggagtggagttggtgacatcattatacgtggggcgacgtactactctccgtcccctcaagagtcgtctcacctnttcgagggacacgtcatgaaccgcttctccctgaaactgaccctccgtgaccgccgcggacacggtcctttattctgtgcgaggcgagactggtctttcaatctagtcggggcgtggcacccgtggtcacgtcgtcctcctcacgtccttaccaccgtaacgggccctagttcccgg

SEQ ID NO: 363229 - DNA, 542 bp, Homo sapiens
  misc_feature: GZ8MTXP02HK18B.44.86.H09.1.454.CMB.2.raw
  modified_base (352)..(352): a, c, t, g, unknown or other
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccaggggaggggaatgggagtggagttggtgacatccattatactggggcgacgtactactctccgtccccctcaagngtcgtctcaccntttcgagggacaccgtccatcgaaacccccttctccctgaaaactcgaccctccgttcgacccgccgcggaccacggctttattctgtcgtcgaggcgagactggtcttcaatctagtggggccgtgggcacccgtggtcactcgtctcctcaagtctccacacggccagtcggtccc

SEQ ID NO: 363230 - DNA, 549 bp, Homo sapiens
  misc_feature: GZ8MTXP02J2487.44.86.H09.1.454.CMB.2.raw
  modified_base (356)..(356): a, c, t, g, unknown or other
  modified_base (449)..(449): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggaggggaatggagtggagttggtgacatccattatactggggcgacgtactactctccgtcccctcaagacgtcgtcncaccatttcgagggacacgtccatcgaacccgcttcgtccctgaaactcgaccctccggtgacccgccgacggacacggtcccgtttattccngtgcgaggcgagactggtctttcgaattctagtgggccgtggccacccgtggtccactcgtcctcctcgacgccttccaccgaacgggcccagttcccgg

SEQ ID NO: 363231 - DNA, 543 bp, Homo sapiens
  misc_feature: GZ8MTXP02I14M4.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggtccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccccctcagagtcgtctcaccntttcgagggacacgtccatcgaacccgcttctccctgaaactgaccctccgtcgaccgccgcggacacggtccgtttatttctgttgcgtaggcgagactggtctttcaatctagtggggccgtggccacccgtggtcacgtcgtctcctcgacgcttccaccgtaacgggcccagttcccgg

SEQ ID NO: 363232 - DNA, 547 bp, Homo sapiens
  misc_feature: GZ8MTXP02I5BMP.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggacggggaatggagtggattggtgacagtccattatactggggcgacgtactactctccgtccccctcaagagtcgtctcaccntttcgagggacacgtccatcgaaccgcttctccctgaaactgacctccgtcgaccgccgcggacacggtccgtttattctgtgcgaggcgagactggtcttcaatctagtcggggccgtggcacccgtggtccacgtcgtcctccgtcacgtcttacccaccgtaacgggccccagttccccgg

SEQ ID NO: 363233 - DNA, 539 bp, Homo sapiens
  misc_feature: GZ8MTXP02FTMQ9.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgaggaggggaatggagtggattggtgacatccattatactggggcgacgtactactctccgtcccctcagagtcgtctcacctnttcgagggacacgtccatgaaccgcttctccctgaaactgaccctcgtgaccgccgcggacacgtccgtttattctgtgcgaggcgagactggtctttcaatctagtggggccgtggccaccctggtcacgtcgtcctccgtcacgccttaccaccgtaacgggcccctagttccccgg

SEQ ID NO: 363234 - DNA, 546 bp, Homo sapiens
  misc_feature: GZ8MTXP02G1YQD.44.86.H09.1.454.CMB.2.raw
  modified_base (359)..(359): a, c, t, g, unknown or other
  modified_base (422)..(422): a, c, t, g, unknown or other
  modified_base (495)..(495): a, c, t, g, unknown or other
  modified_base (511)..(511): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagcccccagggaggggaatggagtggagttggtgacatccattatactggggcgacgtactactctccgtcccctcaagagtcgtctcaccntttcgagggacacgtccatgaaccgcttctccctgaaactgaccctcgtcgaccgccgcgacncggtcgtttattctgtgcgtaggcagactggtctttcaatctagtcggggtccgtgggcctacccgtggtccncgttcgccttccgtcncgtccttccaccgaacgggccctacgtttccccgg

SEQ ID NO: 363235 - DNA, 525 bp, Homo sapiens
  misc_feature: GZ8MTXP02HYF2I.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcccctcaagagtcgtctcactntttcgagggacaccgtccatcgaacccgcttctccctagaactcgaccctcgtcgaccgccgcgacacggcgtttattctgtgcgagcgagactggtcttcatctagtggggcgtggcaccctggtcactcgtctctcgacgcttccacaacggcccacgtccgg

SEQ ID NO: 363236 - DNA, 538 bp, Homo sapiens
  misc_feature: GZ8MTXP02JU6GK.44.86.H09.1.454.CMB.2.raw
  modified_base (361)..(361): a, c, t, g, unknown or other
  modified_base (411)..(411): a, c, t, g, unknown or other
  modified_base (432)..(432): a, c, t, g, unknown or other
  modified_base (442)..(442): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggtccaggactggtgaggccttcgggaaccctgtctctcatctgcactgtctctggagtttccatcagttctgatcattcttggggctggatccggcagcccccagggagggaatggagtggattggtgacatccattatacgtggggcgacgtactactctccgtccccctcaagagtcgtctcaccntttcgagggacacgtccatcgaaccgcttctccctgaaactgaccttcgngaccgcgcgacacgccgtttntcgtgtgcgnggcgagtcgtgtcttacagtcgtagtcggtcgtcgccgtaccgtcgtctacgtcgtcctcgtaacgtcgtcctaccaccgaccgaccgtacgtccg

SEQ ID NO: 363237 - DNA, 546 bp, Homo sapiens
  misc_feature: GZ8MTXP02HRAST.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcccctcaagagtcgtctccacntttcgagggacacgtccatcgaaccgcttcctccctgaaactgaccctcgtcgaccgccgcggacacggtccgtttatttctgttgcgaggcgagactggtctttcaatctagtcgggccgtggcacccgtggtccacgtcgtctcctcgacgtccttcccaccgtaacgggccctagttccccgg

SEQ ID NO: 363238 - DNA, 535 bp, Homo sapiens
  misc_feature: GZ8MTXP02F9KFC.44.86.H09.1.454.CMB.2.raw
  modified_base (360)..(360): a, c, t, g, unknown or other
  modified_base (410)..(410): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggagttggtgacatccattatactggggcgacgtactactctccgtcccctcagagtcgtctcaccntttcgaggacacgtccatcgaaccgcttctccctagaaactgacctccgngacccgccgcgacacggtccgtttattctagtgcgaggcgagactggtcttcaatctagtgggccgtgcaccgtggtcactgtcctccgtcgacgtccttaccaccgtaacggcccagttcccgg

SEQ ID NO: 363239 - DNA, 555 bp, Homo sapiens
  misc_feature: GZ8MTXP02FRG6S.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggagttggtgacagtccattagtactggggcgacgtactactctccgtcccctcaagagtcgtctcaccntttcgagggacacgtccatcgaaccgtcttctccctagaaactcgaaccctccgtcgaccgccgcggacaccggtccgtttattctgtgcgaggcgacgactggtctttacgaatctagtgggccgtggccacccgtggtctacgtcgtctcctcacgtcttacccaccgtaaccgggcctacgttcccgg

SEQ ID NO: 363240 - DNA, 511 bp, Homo sapiens
  misc_feature: GZ8MTXP02HR02J.44.86.H09.1.454.CMB.2.raw
  modified_base (284)..(284): a, c, t, g, unknown or other
  modified_base (306)..(306): a, c, t, g, unknown or other
  modified_base (499)..(499): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaaacngacatggcatgcactgggtccnccaggctccaggcaagggctgggagtgggtgcacttatatgggtatgatggaataataatattatgtagattcgtagaaggcgattcacatctccagagacaattcgaaagaacacactaatatctaggaaatgaaatagctagagagccgagacacggctgtctactactcgtagcgagaagagtggggacngtggatacgaag

SEQ ID NO: 363241 - DNA, 519 bp, Homo sapiens
  misc_feature: GZ8MTXP02JGEW7.44.86.H09.1.454.CMB.2.raw
  modified_base (426)..(426): a, c, t, g, unknown or other
  modified_base (485)..(485): a, c, t, g, unknown or other
  modified_base (491)..(491): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcggtggtccgagccgtgggaggtcctgagactctcctgtgtagcgtctggattcaccttcaacagacatggcatgcacgtgggtccgccaggctccgaggcaaggggactgggagtgggtggcacgttatagtggtatgatggaataatatattatgtagattcgtagaacgggccattccacatctcagacgacaatcgaaanaatacatatactctagaaatgaatgctagagagaccgagtacacggctgtactactacngtacgngagaagagtggcgtgtcgtacgacgaag

SEQ ID NO: 363242 - DNA, 559 bp, Homo sapiens
  misc_feature: GZ8MTXP02HJPO7.44.86.H09.1.454.CMB.2.raw
  modified_base (528)..(528): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactctccgtccccctcaagagtcgtctccactatttcgagggacacgtccatcgaacccgcttctccctagaaactcgaccctccgtcgaccgccgcggacacggtccgtttatttcgtgttgcggaggcgagactggtctttcaattcgtagtcggggccgtggccacccgtggtccacgtcgtcctcctaacncgcttccgaccgaacgggcccacgttcccgg

SEQ ID NO: 363243 - DNA, 529 bp, Homo sapiens
  misc_feature: GZ8MTXP02ICYTF.44.86.H09.1.454.CMB.2.raw
  modified_base (363)..(363): a, c, t, g, unknown or other
  modified_base (392)..(392): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggaggggaatggagtggattggtgacatccattatacgtggggcgacgtactactctccgtccccctcaagagtcgtctcaccntttcgaggacacgtccatgaaccgcttcnccctgaaactgacctccgtgaccgccgcgacacggccgtttattctgtgcgaggcgagactggtctttcaatctagtggggccgtggccaccctggtcactcgtctcctcagccttccaccaacggccctatcccgg

SEQ ID NO: 363244 - DNA, 568 bp, Homo sapiens
  misc_feature: GZ8MTXP02GZX8Q.44.86.H09.1.454.CMB.2.raw
  modified_base (423)..(423): a, c, t, g, unknown or other
  modified_base (440)..(440): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggatggagtggattggtgacagtccattatactggggcgacgtactactctccgtccccctcaagagtcgtctcacatttcgagggacacgtccatgaacccgctctccctgaaactgacctccgtcgaccgccgcgacncggtccgtttatttccngttgcgtaggccgagactggttcttcgaatcgtagtcgggggtccgtggcctacccgttgggtcctaccgttcggttcctcctctcggcctttcccgaaccgaacggggtcccccaagtttccccggg

SEQ ID NO: 363245 - DNA, 525 bp, Homo sapiens
  misc_feature: GZ8MTXP02G9NI8.44.86.H09.1.454.CMB.2.raw
  modified_base (361)..(361): a, c, t, g, unknown or other
  modified_base (422)..(422): a, c, t, g, unknown or other
  modified_base (469)..(469): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatggggtcctgtcccaggtgcagctgcaggagtcgggcccaggactggtgaggccttcgggaaccctgtctctcatctgcactgtctctggagtttccatcagttctgatcattcttggggctggatccggcagcccccagggagggaatggagtggattggtgacatccattatactggggcgacgtactactctccgtccccctcaagagtcgtctcaccntttcgagggacacgtccatgaaccgcttctccctgaaactgacctcgtgaccgccgcgacncggccgtttattcctgttgcgaggcgagactggtctttcaatctagnggggtcctgggccaccctggcactcgtctctcagccttcacaacggcccattcccg

SEQ ID NO: 363246 - DNA, 563 bp, Homo sapiens
  misc_feature: GZ8MTXP02J25CC.44.86.H09.1.454.CMB.2.raw
  modified_base (358)..(358): a, c, t, g, unknown or other
  modified_base (388)..(388): a, c, t, g, unknown or other
  modified_base (407)..(407): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagcccccagggaggggaatggagtggattggtgacatccattatactggggcgacgtactactctccgtcccctcaagacgtcgtctcacntttcgagggacacgtccatgaaccgcttcnccctgaaactgacctcgtnacccgcgcggacacggtccgtttattctgtgcgagggcgagacgttggtctttcgaattctaagtcggggccgtcggaacccctgggtaccacgtcgtcctcccgttacgaacgtccttaccaccgtaacgggcccctaacgtccggtttcccccg

SEQ ID NO: 363247 - DNA, 546 bp, Homo sapiens
  misc_feature: GZ8MTXP02GMWCM.44.86.H09.1.454.CMB.2.raw
  modified_base (360)..(360): a, c, t, g, unknown or other
  modified_base (389)..(389): a, c, t, g, unknown or other
  modified_base (421)..(421): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccagggaggggaatggagtggattggtgacatccattatactggggcgacgtactactctccgtcccctacaagagtcgtctcaccntttcgaggacacgtcatgaaccgtcttcnccctagaaactgaccctcgtgaccgcgcgacncggtccgtttattctgtgcgagggcgagaccgtggttctttcgaaatcgtagcggggtcctggcacccgtggtcacgttcgtcctcctcacgtccttacccaccgaaacggccctagttccccgg

SEQ ID NO: 363248 - DNA, 550 bp, Homo sapiens
  misc_feature: GZ8MTXP02JI1Q0.44.86.H09.1.454.CMB.2.raw
  modified_base (367)..(367): a, c, t, g, unknown or other
  modified_base (450)..(450): a, c, t, g, unknown or other
  modified_base (474)..(474): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgagggaggggatggagtggagttggtgacatccattatacgtggggcgtacgtactactctccgtcccctcaagagtcgtctccactntttcgagggacacgtcatcgaaccgtcttctaccctgaaacctgaccctcgtcgacccgcgccgacgccgtccgtttatttcngtgcgagggcagacctggtctttnaattctagtcggggctggcacccgtggtcacctgtcctcctcgacgtcttacccgacgaacgggtcccagttcccg

SEQ ID NO: 363249 - DNA, 579 bp, Homo sapiens
  misc_feature: GZ8MTXP02H99MC.44.86.H09.1.454.CMB.2.raw
  modified_base (409)..(409): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgattcattcttggggctggatccggcagcccccgagggaggggaatggagtggagttggtgacatccattatactggggcgacgtactactctccgtccccctcaagacgtacgtctccaccctattttaccgagggaccaccgttccagtcaaaccgcccttcncccctagaaactcgaccctccgtcgacccgccgccgggacaccggccgttttatttctgttgcgtagggcgagacgttggtctttcaattcgttaagtcggggtcctgggccaccgtcgggtcactcgttcctcctcgatccttaccacctaacgggccctagttcccgg

SEQ ID NO: 363250 - DNA, 577 bp, Homo sapiens
  misc_feature: GZ8MTXP02JHLAY.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaatggaggtggattggtgacatccattatacgtggggcgacgtactactctccgtccccctcaagagtcgtctcacctntttcgaggacacgtcatcgaaccgtcttctccctgaaactcgacctccgtcgaccgccgcggacacggtccgtttattcgtgttcgcgtagggcgagactggttctttcaagttcgtagtcgggggtccgtgggcctaccccgtgggtacctacgttcgtccttcccgtcacgtccttacccgaccgtaacgggcccctagtttccccgg

SEQ ID NO: 363251 - DNA, 548 bp, Homo sapiens
  misc_feature: GZ8MTXP02GCMLK.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcagcccccagggacgggaatggagtggattggtgacatccattatactggggcgacgtactactctccgtcccctcaagagtcgtctcacnttcgagggacacgtccatgaaaccgcttactccctagaaactgaccctccgtcgaccgccgcggacacgtccgtttattctgtgtcgaggcgagactggtctttacagtcctagtcggggcgttgggcctacccgtggtcacgtcgtctcctcacggccttaccaccaacgggccccagtttccccgg

SEQ ID NO: 363252 - DNA, 573 bp, Homo sapiens
  misc_feature: GZ8MTXP02IXILY.44.86.H09.1.454.CMB.2.raw
  modified_base (362)..(362): a, c, t, g, unknown or other
  modified_base (421)..(421): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacatcattatactggggcgacgtactactctccgtccccctcaagagtcgtctcactnttcgaggacacgtccatcgaaccgctctccctagaaactgacctcgcgaccgcgcgacncgtccgtttattctgtgccgtaggcgagacgtggtctttacgaattcgtagtcggggtccgtggccgtacccgtgggtcctacgttcgtccgttccctaacgtacgtccctttacccgaacccgaaaccgggtcccgtaacgtttccccggg

SEQ ID NO: 363253 - DNA, 570 bp, Homo sapiens
  misc_feature: GZ8MTXP02HQBZF.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggattggtgacagtccattatacgtggggcgacgtactactctccgtcccctcaagtagtcgtctccaccntttcgaggacacgtccatcgaaccgcttctccctagaaactcgacctccgtcgaccgccgcgacacggccgtttattctgttgcgtaggcgagacgtggttctttcaagtctaagtcggggccgtggccacccgtgggtcctacgttcgtccgtcctcgtacgtcctttacccgaccgtaacggggcccctaacgttccccgg

SEQ ID NO: 363254 - DNA, 581 bp, Homo sapiens
  misc_feature: GZ8MTXP02HW0LB.44.86.H09.1.454.CMB.2.raw
  modified_base (371)..(371): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaatggagtggagttggtgacatcctattatacgtggggcgacgtactactctccgtcccctacaagacgtcgtctcgacctntttcgagggacaccgtccatcgaaccgctttcctccctagaaacctgaaccctccgtcgaccgccgacgaccacggtccgtttattctgtcgcgaggccgagactggttctttacgaatcgttagtcgggggtccgttcggcctacccgtgggtcctacgtcgttcctcctcgacgtccttcccgaaccgtacggccctacgttccccgg

SEQ ID NO: 363255 - DNA, 538 bp, Homo sapiens
  misc_feature: GZ8MTXP02F3EMP.44.86.H09.1.454.CMB.2.raw
  modified_base (282)..(282): a, c, t, g, unknown or other
  modified_base (429)..(429): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggnggggaatggagtggattggtgacatccattatactggggcgacgtactactctccgtccccctcaagagtcgtctcaccatttcgagggacacgtccatcgaaccgcttctccctgaaactgaacctccgtcgaccgccgcggaccncggccgtttattcctgtgcgaggcgagactggtctttcgaatctagtggggccgtggcaccctggtcactcgtctcctcacgtcttaccacctaacgggcccatcccgg

SEQ ID NO: 363256 - DNA, 561 bp, Homo sapiens
  misc_feature: GZ8MTXP02HQ7MA.44.86.H09.1.454.CMB.2.raw
  modified_base (361)..(361): a, c, t, g, unknown or other
  modified_base (438)..(438): a, c, t, g, unknown or other
  modified_base (472)..(472): a, c, t, g, unknown or other
  modified_base (508)..(508): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgaggggagggaatggagtggagttggtgacgatccattatacgtggggcgacgtactactctccgtcccctacaagacgtccgtntccactgtttacgaggacacgttaccatcgaaacccgcttcctccctgaaactcgaccctcgtcgaccgccgcgacncgtctttattctgtgcgagcgagactggtctttnaattcgtagtcgggccgtggcctacccgtggtaccncgttcgtcctctcctacgtcccttaccgaaccgtacgggccctagttccccgg

SEQ ID NO: 363257 - DNA, 550 bp, Homo sapiens
  misc_feature: GZ8MTXP02GDYHI.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggaggggaatggagtggattggtgacatccattatacgtggggcgtacgtactactctccgtcccctcaagagtcgtctcacctnttcgaggacacgtcatcgaaccgcttctccctgaaactgacctccgtgaccgccgcggacacggtccgtttacttcgtcgtcgcgagggcgagacgtggtcttcaatctagtgggccgttggccaccttggactctcgtctcccgtcacggccttacccacctaacgggccccagtttccccgg

SEQ ID NO: 363258 - DNA, 575 bp, Homo sapiens
  misc_feature: GZ8MTXP02JPNCY.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacgatccattatacgtggggcgacgtactactctccgtccccctcaagagtcgtctcacctntttcgagggaccacgtccatcgaaacccgtcttcctcccctagaaactcgaccctccgtcgaccgtcccgcggacacggtccgtttatttctgtgcgagggcgagtactggttctttacaagttccgtagtcggggtccgttggcctacccgtggtacctacgtcgtcctcctcgacgtcccttccgaaccgacggcccacgtttccccgg

SEQ ID NO: 363259 - DNA, 529 bp, Homo sapiens
  misc_feature: GZ8MTXP02I8HFL.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatggagtggagttggtgacagtccattatacgtggggcgacgtactactctccgtccccctcaagatcgtctcacntttcgagggacacgtctatcgaacgcttctccctagaaactgaccctcgtgacccgcgcgacgacgtccgtttattctgtgcgaggcgagactggtcttcaattctagtggggccgtggcctacccgtggtcactcgtctcgcagccttcacaacggccacgtccg

SEQ ID NO: 363260 - DNA, 554 bp, Homo sapiens
  misc_feature: GZ8MTXP02HPHKJ.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccatcagttctgatcattcttggggctggatccggcagcccccagggaggggaatggagtggattggtgacatccattatactggggcgacgtactactctccgtccccctcaagacgtcgtctccacntttcgagggacacgttccatcgaacccgcttctccctgaaactcgaccctccgtcgacccgccgcgacaccggtccgtttatttctgttgcgagggcgagctggtctttcaatctagtcggggccgtgggcctaccgtggtccacgtcgtcctcctcgacgccttccaccgtaacgggccctagttcccgg

SEQ ID NO: 363261 - DNA, 576 bp, Homo sapiens
  misc_feature: GZ8MTXP02H4B62.44.86.H09.1.454.CMB.2.raw
  modified_base (363)..(363): a, c, t, g, unknown or other
  modified_base (395)..(395): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattatacgtggggcgacgtactactctccgtcccctcaagagtcgtctcacctntttcgagggacacgtccatcgaacccgcttcnccctagaaactcgaccctccgtcgaccgccgacggacacggtccgtttatttccgtggttgccggtaggccgagtacgtggttcttcaagttccgtagtcgggggccgtggacctacccgtggtccacgttcgtcctcctcgacgtccttcccgaccgaacggggccctacgtttccccgg

SEQ ID NO: 363262 - DNA, 537 bp, Homo sapiens
  misc_feature: GZ8MTXP02GW1B3.44.86.H09.1.454.CMB.2.raw
  modified_base (359)..(359): a, c, t, g, unknown or other
tcagacagtatatacacgaccggtgctcgatttagtgctatagacttgggtttggcgatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccgagggacgggaatggagtggattggtgacatccattatactggggcgacgtactactctccccgtccctcaagacgtcgtctcncctatttcgaggacacgtccatcgaaccgcttcctccctagaaacctcgacctccgtcgacccgccgcgacacggtccgtttattcgtgtgcggtagcgagacgtggtctttcaatctagtcggggccgtggcctaccgtcggtcacgtcgtctctcacgtctccaccacggcctacg

SEQ ID NO: 363263 - DNA, 581 bp, Homo sapiens
  misc_feature: GZ8MTXP02HXANB.44.86.H09.1.454.CMB.2.raw
  modified_base (364)..(364): a, c, t, g, unknown or other
  modified_base (476)..(476): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggattggtgacatccattatacgtggggcgacgtactactctccgtcccctcaagacgtcgtctcacntttcgaggacacgtccatcgaaacccgtcttacctccctagaaacctgaaccctccgtcgacccgccgccggacaccggtcctttattctgtgcgaggcgagactggtcttnaatcgtagtcggggccgttggcctaccgtgggtacctcgttcgttcctcccgtcgtacggtcctttacccgaacccgtaaaccggggtccctaacgtttccccgg

SEQ ID NO: 363264 - DNA, 628 bp, Homo sapiens
  misc_feature: GZ8MTXP02J3LUE.44.86.H09.1.454.CMB.2.raw
  modified_base (568)..(568): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctgggctggatccggcacgccccgagggagggaatggagtggattggtgacatccattatacgtggggcacgtactactctccgtcccctcaagacgtcgtctcacctgttcgacgggaccacgtccatacgaaacccgtcttacctccctagaaaaccgttcgaccctcccggttacgacccggtccgaccgggacctaaccgggttccgttttatttccgtggttcgacggaacggggtcgtaacgtacgtttcgggttactttacgaaagttcgttaacggtcggggtcccgttggcccacccggttcggtaccncgtcgttccctcctccgtacgtcccttaccgaacccgtaacgggcccctagttcccccgg

SEQ ID NO: 363265 - DNA, 572 bp, Homo sapiens
  misc_feature: GZ8MTXP02HXJCT.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccaggggacggggaatggagtggagttggtgacatccattatacgtggggcgacgtactactctccgtcccctcaagtgtacgtctcacctntttcgaggacacgtccatgaaccgcttctccctagaaactgaccctcgtcgaccgccgcgacacggtcctttatttctgtgcgtaggcgagactggtctttcaatctagtcggggtccgtggcctacccgtggtacctacgtcggttcctcctcgtacggtccctttacccgaaccgtaaccggggcccctaacgttcccccggg

SEQ ID NO: 363266 - DNA, 566 bp, Homo sapiens
  misc_feature: GZ8MTXP02HGO2Q.44.86.H09.1.454.CMB.2.raw
  modified_base (349)..(349): a, c, t, g, unknown or other
  modified_base (446)..(446): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactgttgaggccttcgggaaccctgtctctcatctgcactgtctctggtagtttccatcagttctgatctattcgttggggctggactccggcacgccccgagggaggggagtggagtggagttggtgacatcattatacgtgggacacgtactactctccgtcccctanagactctctcactgttcgaggacacgtcatacgaacccgtcttcctccctagaaactcgaccctcgtcgaccgccgacgacacggtcctttattcgngtgcgaggcgagcgtggttctttacaattcgtaggtcggggtccgtcggcctcccgtggtacctcgtcgtcctcctaacacgtccttacccgaaccgtaaccggccctacgtttccccgg

SEQ ID NO: 363267 - DNA, 572 bp, Homo sapiens
  misc_feature: GZ8MTXP02JWY6T.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggacggggaagtggaggtggagttggtgacatccattatacgtggggcgacgtactactctccgtcccctcagacgtcgtctcacctgttcgacggacacgtccatcgaaccgtcttcctccctagaactcgaccctcgtcgacccgccgccgacgccggtccgtttattcgtgtcgcgaggcgagacgttggtctttcaagttctagtcggggtccgtcggccacccgtggtcctacgtcgtcctccgtcgacgtccttacccgaccgtacggccctacgttccccgg

SEQ ID NO: 363268 - DNA, 601 bp, Homo sapiens
  misc_feature: GZ8MTXP02JTY9L.44.86.H09.1.454.CMB.2.raw
  modified_base (454)..(454): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacagtccattatacgtggggcgacgtactactctccgtccccctcaagtagtcgtctcacctatttccgagggacctacgtccatcgaaacccgcttcctccctagaaaccttgaccctcgtcgaccgccgcgacacgtccgttattcgngtgcgaggcgagacgtggtctttcgaattcgtagtcgggggtccgtcgggaccacccgttgggtcctaccgttcggttcccttcccgttccgaacggttcccctttacccgaacccgaaaccggggtcccctaacgtttcccccggg

SEQ ID NO: 363269 - DNA, 583 bp, Homo sapiens
  misc_feature: GZ8MTXP02J3VIE.44.86.H09.1.454.CMB.2.raw
  modified_base (318)..(318): a, c, t, g, unknown or other
  modified_base (370)..(370): a, c, t, g, unknown or other
  modified_base (462)..(462): a, c, t, g, unknown or other
  modified_base (536)..(536): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggaggggaatggagtggagttggtgacatccattanacgtggggcgacgtactactctccgtccccctacagacgtcgtctccacctnttcggaagggacacgtccatcgaaccgcttacctccctagtaaacctcgaccctccgtcgacccggccgcggaccacggtccgtttattcgngtgcgtagggcgtaagccgttggtcctttcaaacgttctacggtcggggtccgtcgggccaccgtcggttaccncgtcgttcctcctcgacgtcctaccgaccgacggtccctacgtcccg

SEQ ID NO: 363270 - DNA, 523 bp, Homo sapiens
  misc_feature: GZ8MTXP02I70HA.44.86.H09.1.454.CMB.2.raw
  modified_base (360)..(360): a, c, t, g, unknown or other
  modified_base (411)..(411): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcccctcaagagtcgtctcaccntttcgagggacacgtccatgaaccgcttctccctgaaactgaaccctcgtnaccgccgcgacacggccgtttatttctgtgcgaggccgagacctggtctttcaatctatggggcctggcaccctggtcactgctcctcgagcttccacaaggcccattcccg

SEQ ID NO: 363271 - DNA, 587 bp, Homo sapiens
  misc_feature: GZ8MTXP02JP9MM.44.86.H09.1.454.CMB.2.raw
  modified_base (363)..(363): a, c, t, g, unknown or other
  modified_base (369)..(369): a, c, t, g, unknown or other
  modified_base (522)..(522): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcagcccccgaggggaggggaagtgggagtggagttggtgacatccattatacgtggggcgacgtactactctccgtccccctcaagagtcgtcncacctntttcgaggcacgtctaatcgaaccgtcttctccctagaaactcgaaccctccgtcgacccgccgcggacacggtccgtttattctgttgcgtaggcgagtctggttcttcaattcgtagtcgggggtccgtggacccgtaccccgtggttacnccgttcgttcctccttcgacgttcccttacccgacccgtaacggggtcccccagtttcccccggg

SEQ ID NO: 363272 - DNA, 530 bp, Homo sapiens
  misc_feature: GZ8MTXP02HTFFT.44.86.H09.1.454.CMB.2.raw
  modified_base (367)..(367): a, c, t, g, unknown or other
  modified_base (444)..(444): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccaggggaggggaagtggagtggagttggtggacagtccattatacgtggggcgacgtactactctccgtcccctcaagagtcgtctccacntttcgaggacacgtccatcgaaccgcttctccctgaaactgacctcgtgaccgccgcgacacgcgtttattctgttncgaggcgagactggtcttcaatctagtcgggccgtggcaccgtggtcactcgtctctcagcttaccacctaacggccctagtcccg

SEQ ID NO: 363273 - DNA, 574 bp, Homo sapiens
  misc_feature: GZ8MTXP02IS07Y.44.86.H09.1.454.CMB.2.raw
  modified_base (356)..(356): a, c, t, g, unknown or other
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggacggggaatggagtggagttggtgacatccattatacgtggggcgacgtactactctccgtcccctcaagngtcgtctcacntttcgaggacacgtccatcgaaccgcttcctaccctagaaactcgaccctccgtcgacccgccgcggaccacggtccgtttattctgtgtcgaggcgagacgtggttcttcgaattcgtagtcggggtccgtggcctacccgtggtacacgtcgttcctccttcgacgtccttacccgaccgtaaacgggcccctacgtttccccgg

SEQ ID NO: 363274 - DNA, 593 bp, Homo sapiens
  misc_feature: GZ8MTXP02F8KEU.44.86.H09.1.454.CMB.2.raw
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggaggggaatggagtggattggtgacatcctattatacgtggggcgtacgtactactctccgtccccctacaagtagtcgtctcacctntttcgagggtacacgtccatcgaaccgtcttctccctagaaacctcgaccctccggtacgacccgccggaccggacaccggtaccttttattcgtggttcgcggtagggcgaacgtacgttggtcttttacaattcgtaggtcggggccgtggcctacccgtggtctacgttgtcctccgtcacgtccttacccgaccgaacgggtcccacgtttccccgg

SEQ ID NO: 363275 - DNA, 554 bp, Homo sapiens
  misc_feature: GZ8MTXP02F67T4.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccagggaggggaatggagtggattggtgacatccattatacgtggggcgacgtactactctccgtcccctcaagagtcgtctcacctnttcgagggacacgtccatcgaaccgcttctccctgaaactgacctccgtgaccgccgcgacacggtccgtttatttcctgtcgcgaggcgagctggtctttcgaatcgtagtcggggcctgggcctaccgttcggtctaccgttcgtcctcctcacgtccttaccgacccgaagggtccccagttccccgg

SEQ ID NO: 363276 - DNA, 525 bp, Homo sapiens
  misc_feature: GZ8MTXP02HSB4E.44.86.H09.1.454.CMB.2.raw
  modified_base (206)..(206): a, c, t, g, unknown or other
  modified_base (305)..(305): a, c, t, g, unknown or other
  modified_base (317)..(317): a, c, t, g, unknown or other
  modified_base (443)..(443): a, c, t, g, unknown or other
tcagacagtatatacacgaccggtgctcgatttagtgctatagacttgggtttggggagcttcagctgtggtagagaagacaggattcaggacaatctccagcatggccggcttccctctcctcctcaccctcctcactcactgtgcagggtcctgggcccagtctgtgctgactcagccatcctcagcgtctcgggacccccggnagacggtcacgatctttgtctggaagtaggtccaaacatcggaaagtaattacgtatactggtatcggcaaattcacaggagcggtccccagacccctnatctataggganaatcagcgccctgaggggccctgaccgattcctctcgcctaccaagtctggcacctcacgcctccctgccatcagtggcctccggtcgacgatgagctgattattctgtgcggtcgttgggatganatctgagtggactgctagtcggcggacggaccaagtcgcgaccgtcgtaaacgtcaacgaccaacggcctcgcccccgtcgg

SEQ ID NO: 363277 - DNA, 510 bp, Homo sapiens
  misc_feature: GZ8MTXP02I1JSK.44.86.H09.1.454.CMB.2.raw
  modified_base (283)..(283): a, c, t, g, unknown or other
  modified_base (342)..(342): a, c, t, g, unknown or other
  modified_base (363)..(363): a, c, t, g, unknown or other
  modified_base (367)..(367): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtggagctggtggagtctgggggaggcgtggtccagcctgggaggtccctgagactctcctgtgtagcgtctggattcaccttcaacngacatggcatgcactgggtccgccaggctccaggcaagggctggagtgggtgcacttanatggtatgatggaataatatnttangtagattcgagaaggcatcacatctccagacgaacaattacgaaagaacacaactaatatactaggaaatagaatagctagagagaccgagacacggctgtctactactcgtgcgagaagagtggggactcgtggatacgaag

SEQ ID NO: 363278 - DNA, 570 bp, Homo sapiens
  misc_feature: GZ8MTXP02H32C5.44.86.H09.1.454.CMB.2.raw
  modified_base (370)..(370): a, c, t, g, unknown or other
  modified_base (400)..(400): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaatggagtggagttggtgacatccattagtacgtggggcgacgtactactctccgtcccctcaacgacgtcgtctcaccctntttcgaggacacgtccatcgaaccgcttcnccctgaaactcgacctccgtcgaccgccgcggacacggtccgtttattccgtgtgcgagggcgagtactggttcttacaacgttctagtcggggtcccgtggcctacccgtgggtactacgtcgttcctcctcgacgtccttcccaaccgaacgggtccctacgtcccgg

SEQ ID NO: 363279 - DNA, 566 bp, Homo sapiens
  misc_feature: GZ8MTXP02IG9UW.44.86.H09.1.454.CMB.2.raw
  modified_base (375)..(375): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcactgtctctggagtttccatctagttctgatcattcgttggggctggatccggcacgcccccgaggggacggggaagtgggagtggagttgggtgacatcctattagtacgtggggcgacgtactactctccgtcccctcaagcgtcgtctcacctntttcggaggaccacgtccagtacgaaccgccttctccctagaaacctcgacccgtccgtcgacccgtccgacgacgacgtccgtttattcgtgtgcgtaggcgagcttggtcttcaatctagcgggtccgtggccacctggtcacgtcgtctcctcacgtccttacccacgaacgggccctagttccccgg

SEQ ID NO: 363280 - DNA, 568 bp, Homo sapiens
  misc_feature: GZ8MTXP02HAGTT.44.86.H09.1.454.CMB.2.raw
  modified_base (433)..(433): a, c, t, g, unknown or other
  modified_base (449)..(449): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaatgggagtggattggtgacatccattatacgtggggcgacgtacgtactctccgtccccctcaagagtcgtctcaccagtttcgagggaccacgtccatcgaaaccgcttcctccctgaaactgacctccgtcgaccgccgcgacncggtcctttagtttcngtgcgtagggcgagacgtggttcttcgtaatcctagtcggggtccgtcggcacccgttgggcctacgtcgtcctcctcgacgtccttcccgacccgaacgggcccctacgtttccccgg

SEQ ID NO: 363281 - DNA, 584 bp, Homo sapiens
  misc_feature: GZ8MTXP02I3OXK.44.86.H09.1.454.CMB.2.raw
  modified_base (446)..(446): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatctagttctgatctattcgttggggctggagtccggcacgcccccgaggggacggggaagtggaggtggagttggtgacatcctattatacgtggggcgtacgtactactctccgtcccctcaagagtcgtctcactgtttcgaggacaccgtccatcgaaccgtcttcctccctagaaactcgaccctccgtcgacccgcgccggacncggtcgtttactttcgtgtgcgaggcgacgacgttggttcttacaatcgtagtcggggtccgtggcctaccgtggtcctacgtcggtcctccgtcgacgtccttacccaaccgtaacgggtccctacgtttcccccgg

SEQ ID NO: 363282 - DNA, 603 bp, Homo sapiens
  misc_feature: GZ8MTXP02JRP2R.44.86.H09.1.454.CMB.2.raw
  modified_base (355)..(355): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaagtggaggtggagttggtgacatccattatacgtggggcgacgtactactctccgtcccctcaagngtcgtctcacctgtttcgagggaccacgtccatcgaacccgtcttcctccctagaaactcgaaccctccgtcgacccgccgcggacacggtccgtttattctgtgcgaggcgagtacgtggttctttcaagttcgtagtcgggggtcccgtgggccctaccccgttgggtcctaccgttcgttcccttcccgtccgtacggtcccttaccccgaaccgtaaccggggtccccctaagtttcccccggg

SEQ ID NO: 363283 - DNA, 572 bp, Homo sapiens
  misc_feature: GZ8MTXP02HK3M9.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatgggagtggagtttggtgacgatccattatactggggcacgtactactctccgtccccctcaagagtcgtctcaccntttcgagggacacgtccatgaacccgcttcctccctagaaactcgaccctccgtcgaccgccgcggacacggtccgtttattctgttgcgtaggcgagactgggtctttcaattcgtagtcgggggtccgtggccgtacccgtgggtcctacgttcggtcctcccttcgacgtcctttcccaccgtaacgggcccctaagttccccgg

SEQ ID NO: 363284 - DNA, 560 bp, Homo sapiens
  misc_feature: GZ8MTXP02G0TW6.44.86.H09.1.454.CMB.2.raw
  modified_base (368)..(368): a, c, t, g, unknown or other
  modified_base (529)..(529): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcgatctgcactgtctctggtatttccatcagttctgatcattcttggggctggatccggcacgcccccagggacggggatggagtggagttggtgacatccattatacgtggggcgacgtactactcgtccgtcccctcgaagagtcgtctcgactntttcgaggacacgtcatcgaaccgtcttcctcccgtagtaaacctgaccctcgtcgaccgcccgcggaccacggtccgtttacttcgtcgtcgcgtaggcgaacgtacgttggtctttcaattcgtagtcggggtcgtggactcccgtgtcactcgtctcncgtacgcttaccacgacggccacgttcccgg

SEQ ID NO: 363285 - DNA, 570 bp, Homo sapiens
  misc_feature: GZ8MTXP02HRESQ.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggaggggaatgggagtggagttggtgacatcattatacgtggggcacgtactactctccgtcccctcaagtacgtccgtctccactntttcggaggacaccgtccatcgaacccgtcttcctccctagaaaactcgtaccctccgtcgacccgccgcggactacggtccgtttattctgtgcgtaggcgagtacgtggtctttcaattcgtagtcggggccgtgggccaccgtcggtctacgtcgtcctcctcgacgtccttaccgaccgtacggccctagttccccg

SEQ ID NO: 363286 - DNA, 511 bp, Homo sapiens
  misc_feature: GZ8MTXP02GX2FW.44.86.H09.1.454.CMB.2.raw
  modified_base (349)..(349): a, c, t, g, unknown or other
  modified_base (367)..(367): a, c, t, g, unknown or other
  modified_base (377)..(377): a, c, t, g, unknown or other
  modified_base (421)..(421): a, c, t, g, unknown or other
  modified_base (438)..(438): a, c, t, g, unknown or other
tcagacagtatatacacgaccggtgctcgatttagtgctatagacttggggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaacagacatggccatcgacacgtgggtccgcaggcctccgaggcaaggggctgggagtgggtgcacttanatggtatgatggaataanatatatgtanattcgagaaggccagtcacatctcagagacaatcgaaagaacanactatatctaggaaatnaatagctagagacgcgagacacggactgtctactactgtagcgagaaggagtggggactcgtaggactaacag

SEQ ID NO: 363287 - DNA, 646 bp, Homo sapiens
  misc_feature: GZ8MTXP02ILEUP.44.86.H09.1.454.CMB.2.raw
  modified_base (375)..(375): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggatccggcacgcccccgaggggacgggaagtggaggtggagttggtgacatccattatacgtggggacgacgtactactcctccgtcccctacaagcgtcgtctcacctntttcggaggaccaccgtccatcgtaacccgctttccaccctagaaactcgaccctccgtcgacccgcccggtaccggaccgaccgggttccgttttactttccgtcggttcggacggtacgggaccggtacgtaccgttgggttacctttacgtaaacgttccgtagtccgggggtccgttcggtcccgtacccgttcgggtcctacgttcgtccttccgttcgacgtcccttacccgaccggtaaccgggccccttacgtttcccccggg

SEQ ID NO: 363288 - DNA, 550 bp, Homo sapiens
  misc_feature: GZ8MTXP02I74BS.44.86.H09.1.454.CMB.2.raw
  modified_base (522)..(522): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacagtccattatacgtggggcgtacgtactactctccgtcccctcaacgagtccgtctccacctagtttcgaggggtaccacgtccatcgaaacccgtcttcctccctagaaactcgaaccctccgtcgacccgccgcggacacggtccttatttcgtcgtgcgaggcgagtctaggtctttcaatcgtagtcgggcgtgcacctggtcactcgtctccncgacgcttccgacacggccagttcccgg

SEQ ID NO: 363289 - DNA, 547 bp, Homo sapiens
  misc_feature: GZ8MTXP02IJGGD.44.86.H09.1.454.CMB.2.raw
  modified_base (281)..(281): a, c, t, g, unknown or other
  modified_base (362)..(362): a, c, t, g, unknown or other
  modified_base (444)..(444): a, c, t, g, unknown or other
  modified_base (512)..(512): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggnggggaatggagtggagttggtgacatccattatactggggcgacgtactactctccgtccccctcaagacgtcgtctcacntttcgagggacacgtccatgaaccgcttctccccgaaactcgaccctccgtcgacccgccgcggacacggtccgtttattcngtgcgtaggcgagactggtctttcgaatctagtggggccgtggcacccgtggtcacgtcgtctcctcncgccttccaccgaacgggccccacgttccggtccc

SEQ ID NO: 363290 - DNA, 555 bp, Homo sapiens
  misc_feature: GZ8MTXP02JQ7DI.44.86.H09.1.454.CMB.2.raw
  modified_base (362)..(362): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccgagggaggggaatggagtggattggtgacatccattatacgtggggcgacgtactactctccgtcccctcagacgtcgtctcacctntttcgagggacacgtccatcgaaccgcttctccctgaaactgaccctcgtcgaccgccgcggacacggcctttattctgtcgcgagggcagactggtctttcaatctagtcggggtctgggctacccgtggtcacgtcgtcctccgtaacgacgtcctttacccgaccgtaacgggccccaagtttccccggg

SEQ ID NO: 363291 - DNA, 574 bp, Homo sapiens
  misc_feature: GZ8MTXP02INIOL.44.86.H09.1.454.CMB.2.raw
  modified_base (468)..(468): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttgggctggatccggcacgcccccgaggggagggatggagtggagttggtgacatccaattagtacgtggggacgacgtactactctccgtcccctacaagacgtcgtctccacctgtttcgagggacaccgtccatcgaaccgtcttactccctagaaactcgaccctcgtcgaccgcccgcggacacggtcctttattcgtgtgcgaggcngacttggtctttgaactcgtagtcgggtacgtcggcctacccgtgggtcctacgtccgtcctccgtcgacgtccttacccgaccgaacggtccctagtttccccgg

SEQ ID NO: 363292 - DNA, 563 bp, Homo sapiens
  misc_feature: GZ8MTXP02HY5E6.44.86.H09.1.454.CMB.2.raw
  modified_base (363)..(363): a, c, t, g, unknown or other
  modified_base (530)..(530): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttggggctggatccggcagcccccagggaggggaatggagtggagttggtgacatccattatactggggcgacgtactactctccgtccccctcaagagtcgtctccacntttcgagggacaccgtccatgaacccgtcttcctccctagaaacctcgaacccttcccgtcgacccgcccggccgacgaccggtccgttttatttctggtgcgagggcgagactggtctttcgaattcgtagtggggccgtggccacccgtggtcacgtcgtcctcncgacgccttaccaccgacggccctagttcccgg

SEQ ID NO: 363293 - DNA, 608 bp, Homo sapiens
  misc_feature: GZ8MTXP02J22L0.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactctccgtcccctcaagacgtcgtctcactnttcgagggacacgtccatcgaaccgcttcctccctagaaactcgaaccctccgtcgacccgccgcggactacggtccgtttattctgtgcgaggcgagacgttggtacctttacgaacttcgtaacggtcgggggtcccgttcgggacccacccggttcggtcctaaccgtcggtttccctacccttcgaaccggtcctttaccccgaaccgttaaccggggccccctaagtttcccccggg

SEQ ID NO: 363294 - DNA, 708 bp, Homo sapiens
  misc_feature: GZ8MTXP02JRWD2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtactttccatctagttctgtactctattcgttggggctggactccggcacgccccgaggggagggagtggaggtggagttggtagacatcctattagtacgtggggacgtacgtacctacctccgtcccgtcccctacgaacgtcgtcgtctaccacctacgtttacggaacgggtacctaccgtacctacgtaccgaacccgtccttaccctaccctaacgtaacctcgtaacccgtccggtaccgaccccggtcccggaccgggtaccgtacccgggtttaccgttttactttccgtcggtcggtacgggtacgggtacggtacgtacgttcgggtttactttacgtaaacgttccgttaagggtccgggggtccgttcgggtacccgtacccggttggtacctaccgttcgttccctcccgtcgtaccgtacccttaccgaacccggtaaccggtccccgtaacgtttcccccgg

SEQ ID NO: 363295 - DNA, 566 bp, Homo sapiens
  misc_feature: GZ8MTXP02IVBJD.44.86.H09.1.454.CMB.2.raw
  modified_base (366)..(366): a, c, t, g, unknown or other
  modified_base (447)..(447): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccagggaggggatggagtggagttggtgacatccattatacgtggggcgacgtactactcctccgtccccctacaagagtcgtctcacctntttcgaggtacacgtccatcgaacccgcttcctccctgaaacctgaccctcgtcgaccgccgcgacacgtccgtttattcngtgcgtaggcgagtactggttctttacaattccgtagtcggggtccgttggccctaccgtggtcctacgtcgtcctcctcgtacgtcttacccgaccgtaacgggccacgtttccccgg

SEQ ID NO: 363296 - DNA, 568 bp, Homo sapiens
  misc_feature: GZ8MTXP02GF6QE.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggattggtgacatccattatacgtggggcgacgtactactctccgtcccctcagagtcgtctcacntttcgaggacacgtccatcgaaccgtcttctccctagaaacctgaccctcgtcgaccgccgcggacaccggtccgtttatttcctgttcgcgaggcgagacgtggtctttcaattcgtagtggggtccgtgggccacccgttggtcctacgtcggtcctccttccgagtcccttaccgacccgtaacgggcccctaattcccccggg

SEQ ID NO: 363297 - DNA, 580 bp, Homo sapiens
  misc_feature: GZ8MTXP02IFNSC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggggaaccctgtctctcatctgcactgtctctggagtttccatcagttctgatcattcgttggggctggatccggcacgcccccgaggggaggggaatgggagtggagttggtgacagtccattatacgtggggcacgtactactctccgtcccctacaagagtcgtctcgacctagtttcgaagggacctacgtcccaagtcgaaacccgtcttctccctagaaactcgaaccctccgtcgacccgccgcgacacggtccgtttactttcgtgtgcgaggcgagacttggtctttcaattcgtagtcggggcgttcggcctaccgtggactcgtcgttcctcctcacgtccttaccgaccgaacgggtccctacgtttccccgg

SEQ ID NO: 363298 - DNA, 597 bp, Homo sapiens
  misc_feature: GZ8MTXP02G1NK6.44.86.H09.1.454.CMB.2.raw
  modified_base (367)..(367): a, c, t, g, unknown or other
  modified_base (439)..(439): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgaggggagggaagtggagtggattgggtgacatcctattatacgtggggcgacgtactactctccgtcccctcaagagtcgtctcactntttccgaggacacgtccatcgaaccgcttcgtccctagaaacctgaaccctccgtcgacccgccgcggaccncggtacctttattctcggtgcggtagggcgaagtacgtggttctttacgaacttcgtaacgtcgggggtcccgttcgggcctaacccgtcgggtaccacgttcgtccttccgtcgacgtcctttacccgaaccgaacggggtccccacgtttccccgg

SEQ ID NO: 363299 - DNA, 655 bp, Homo sapiens
  misc_feature: GZ8MTXP02G3LZV.44.86.H09.1.454.CMB.2.raw
  modified_base (315)..(315): a, c, t, g, unknown or other
  modified_base (364)..(364): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtggggacggtccctggagactctcctgtgtagcgtctggattcaccttcaaacagacatggcatgccacgtcgggtccnccaggcctccgaggcgaaaggggctggggagtggggtgactacgtttanagtggtatgatagggaaattaaatattattagtcgtaagtacgtttccggagggaacgggtcccgtaatttacccgaacctagtaccgttacccgaaaggtaactaaacctaaagttaccggaaaacgaaacctaaactaaccttaaagtacttacgttaagggaaaacttaggaaaacttacggaccttaggaaacggacgaccgggaacgaacgacgggtcttacggtactacgttacgtggtacgacggaagaaggacggttcggggactggtaggaactaacgtaag

SEQ ID NO: 363300 - DNA, 584 bp, Homo sapiens
  misc_feature: GZ8MTXP02FTZQD.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggaagtggagtggagttggtgacatccattatacgtggggcgacgtactactcctccgtccccctcaagacgtcgtctccacctnttcgaggacacgtccatcgaacccgtcttcctccctagaaactcgaaccctccgtcgacccgccgcggaccacggtccgtttattctgtgcgtagggcgaagcgttggtctttacaagttcgtagtcggggccgtcggcctaccccgttggtacctacgttcgttccttccctcgacgtccttacccaccgaacgggcccctacgtttcccccgg

SEQ ID NO: 363301 - DNA, 500 bp, Homo sapiens
  misc_feature: GZ8MTXP02H8THQ.44.86.H09.1.454.CMB.2.raw
  modified_base (305)..(305): a, c, t, g, unknown or other
  modified_base (367)..(367): a, c, t, g, unknown or other
  modified_base (375)..(375): a, c, t, g, unknown or other
  modified_base (381)..(381): a, c, t, g, unknown or other
  modified_base (397)..(397): a, c, t, g, unknown or other
  modified_base (402)..(402): a, c, t, g, unknown or other
  modified_base (415)..(415): a, c, t, g, unknown or other
  modified_base (423)..(423): a, c, t, g, unknown or other
  modified_base (429)..(429): a, c, t, g, unknown or other
  modified_base (457)..(457): a, c, t, g, unknown or other
  modified_base (491)..(491): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccncaggcctccaggcaagggctgggagtggggtgcacttatagtggtatgatggaaataatatnttatgtanattcgngaggccgatcacatcncaganacaatcgagacanactatatnagaatnaatagctgagagaccgaggacgacgctntcgtactactgtcgcgagaagagtggggctcggnggactagag

SEQ ID NO: 363302 - DNA, 575 bp, Homo sapiens
  misc_feature: GZ8MTXP02HX3W1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaatggagtggagttggtgacatcctattatacgtggggcgacgtactactctccgtcccctcaacgagtcgtctcactgtttcgagggaccacgtaccatcgaacccgtcttcctccctagaaactcgacccttccgtcgacccgccgcggacgacggtccgtttattcgtgttgcgaggcgagacgtggttctttcaattcgtagtcggggtccgtggcctaccgtcggtcacgtcgtcctctcgacgtccttacccaaccgtacgggaccctacgtttccccgg

SEQ ID NO: 363303 - DNA, 567 bp, Homo sapiens
  misc_feature: GZ8MTXP02IT4N1.44.86.H09.1.454.CMB.2.raw
  modified_base (355)..(355): a, c, t, g, unknown or other
  modified_base (368)..(368): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtggacatccattatacgtggggacgacgtactactctcccgtcccctcagngtcgtctccaccntttcgaggacaccgtccatcgaacccgcttcctccctagaaacctgaaccctccgtcgaccgccgcggacgccggtcgtttactttcgtcgtgcgagggcgacgtacgtcggttcttagaattctagtcggggctcggctacccgtgtactcgtcgtctcctcgacgtcttaccgacgaacggtcctacgtttccccgg

SEQ ID NO: 363304 - DNA, 583 bp, Homo sapiens
  misc_feature: GZ8MTXP02JWE98.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgaggggaggggaagtggagtggattggtgacatccattatacgtggggcgacgtactactctccgtcccctcagacgtcgtctcactntttcgagggacacgtccatcgaacccgcttcctccctagtaaacctcgaaccctccgtcgacccgccgcggaccgacggtccgtttatttcgtgttgcgacgggcgaagtcgttcgggttctttacaattcgtagtcgggggtccgttggccacccgtcgggtcaccgtcgtccttcctcgacgtcctttaccaccggaacggtcccctagttcccgg

SEQ ID NO: 363305 - DNA, 571 bp, Homo sapiens
  misc_feature: GZ8MTXP02G199E.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggagggatggagtggagttggtgacatccattatacgtggggcgacgtactactctccgtcccctcaagtacgtcgtctcactntttcgagggacacgtcatacgaaccgcttctccctagaaactcgaccctcgtcgaccgccgacgacacggtccgtttatttcgtgtcgcgtaggcgagtactggttctttacaattcgtagtcgggggtccgttcggcctacccgtggtcctacgttcgtcctcctcgacgtccttacccaccgtaacggccctagtttccccgg

SEQ ID NO: 363306 - DNA, 568 bp, Homo sapiens
  misc_feature: GZ8MTXP02FXF4K.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcagcccccagggaggggaatggagtggattggtgacatccattatacgtggggcgtacgtactactctccgtcccctacaagagtcgtctcacctnttcgagggacacgtccatcgaaccgcttctccctgaaacctgaaccctccgtcgaccgccgcggacacgtccgtttattcgtcgttgcgagggcgaacgacgtggtctttacaattctaagtcggggcctgggacctacccgtggtctacgtcgtccttcctcgtacgtccttacccgaccgaaacgggccctaagttccccgg

SEQ ID NO: 363307 - DNA, 528 bp, Homo sapiens
  misc_feature: GZ8MTXP02JKEHI.44.86.H09.1.454.CMB.2.raw
  modified_base (496)..(496): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacgatccattatactggggcgacgtactactctcgtccccctcaagagtcgtctcaccatttcgacgggacacgtccatgaaccgtcttctaccctgaaactgaccctcgtgaccgccgcgacacgccgttattctgtgcgaggcgagactggtctttcaatctatcggggccgttgggctacccgtggtacnctcgtctctcagtctccacacggcccatcccg

SEQ ID NO: 363308 - DNA, 569 bp, Homo sapiens
  misc_feature: GZ8MTXP02HDMRY.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacggggaatggagtggagttggtgacatccattatacgtggggcgacgtactactctccgtccccctcaagtagtcgtctcacctntttcgaggacacgttccatcgaaacccgcttctccctagaaactgaacccttccgtcgaccgccgcgaccacggtccgtttattcgtgtcgcgagggccgagtacgttggtctttcgaattcgtaagtcggggaccgtggcctacccgtggtcacgtcgtcctcgtcgacgtccttccaccgacggcccacgttcccgg

SEQ ID NO: 363309 - DNA, 592 bp, Homo sapiens
  misc_feature: GZ8MTXP02JUD5I.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgagggacggggaatggagtggagttggtgacatcattagtacgtggggacgtacgtactactcctccgtcccctcgaagacgtcgtctcactcgtttcgagggtaccacgtccagtagaacccgtcttacctccctagaaacctcgaccctccgtcgacccgccggcgacgaccggtaccgtttattccgtggtagcggtagggcgtacgacgttggttacctttcaagttcgtagtcggggtccgttgggcctacccgtggtctacgtcgtcctcctcgacgtccttccaccgaacggtcccaacgtttccccgg

SEQ ID NO: 363310 - DNA, 548 bp, Homo sapiens
  misc_feature: GZ8MTXP02GCNKI.44.86.H09.1.454.CMB.2.raw
  modified_base (395)..(395): a, c, t, g, unknown or other
  modified_base (442)..(442): a, c, t, g, unknown or other
  modified_base (448)..(448): a, c, t, g, unknown or other
tcagacagtatatacacgaccggtgctcgatttagtgctatagacttgggtttggggatgctttctgggagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggattggtgacgatccattatacgtggggcgacgtactactctccgtcctccaagagtcgtctcaccatttcgagggacacgtccatcgaaccgcttcnccctgaaactcgacctcgtcgaccgccgcgacacgtccgtttattcngtgcgnggcgagacgtggtctttcaattctagtcggggtcctggccaccgtggtcactcgtcctccgtcaacgtccttaccaccgacggcccacgtccggttcccc

SEQ ID NO: 363311 - DNA, 515 bp, Homo sapiens
  misc_feature: GZ8MTXP02HKDM4.44.86.H09.1.454.CMB.2.raw
  modified_base (383)..(383): a, c, t, g, unknown or other
  modified_base (488)..(488): a, c, t, g, unknown or other
  modified_base (498)..(498): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatcctgcagcccccagggagggaatggagtggattggtgacatccattatactgggcgacgtacgtactctcccgtccctcaagagtcgtactcacctatttcgaggtacacgtcatgaacgntctccctgaaactgacctccgtgaccgccgcgacacggccgttttattctgtgcgaggcgagctggtctttcatctagtcggggccgtggccacctggtcacgtntctcctcacnctccaccacggacaccg

SEQ ID NO: 363312 - DNA, 564 bp, Homo sapiens
  misc_feature: GZ8MTXP02H7G7Q.44.86.H09.1.454.CMB.2.raw
  modified_base (374)..(374): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcttggggctggatccggcgacgcccccgaggggacggggaatgggagtggagttggtgacgatcctaattatacgtggggcgacgtactactctccgtcccctcaagacgtcgtctcacctnttcgaggaccacgtccactacgtaacccgtcctctccctagaaactcgaccctccgtcgaccgccgcgactacggtcgtttactttctgtgcgaggcgagacgtcggtcttcaatctacgtcgggccgtcggcctaccgtggtcacgtcgtctcctcgacgtccttaccacgtacgggccctacgtcccg

SEQ ID NO: 363313 - DNA, 536 bp, Homo sapiens
  misc_feature: GZ8MTXP02JWALB.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggattggtgacatccattatacgtggggcgacgtactactctccgtccccctacaagagtcgtctcaccntttcgagggacacgtccatgaacccgcttctccctagaaactgaccctcgtgaccgccgcgacacggcgtttattctgtgcgagggcgagacgtggtctttcaatctagtggggccgtggcacccgtggtcactcgtctcctcacgccttccaccacggccccagttcccg

SEQ ID NO: 363314 - DNA, 554 bp, Homo sapiens
  misc_feature: GZ8MTXP02G36LD.44.86.H09.1.454.CMB.2.raw
  modified_base (448)..(448): a, c, t, g, unknown or other
  modified_base (471)..(471): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatgggagtggagttggtgacatccattatacgtggggcgacgtactactctccgtccccctcaagagtcgtctcacctgtttcgagggacacgtccatcgaaccgcttctccctgaaactgaccctccgtcgaccgccgcgacacggtccgtttattcngtgcgtaggcgagactggtcttnaatcgtagtcggggccgttggctaccctggtcacgtcgtcctcctcgacgtccttccaccgaacgggcccctagtttccccgg

SEQ ID NO: 363315 - DNA, 551 bp, Homo sapiens
  misc_feature: GZ8MTXP02FUCUN.44.86.H09.1.454.CMB.2.raw
  modified_base (488)..(488): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcagcccccagggaggggaatggagtggagttggtgacatccattatacgtggggcgacgtactactcctccgtccccctcaagagtcgtctaccacctatttcggacgggacacgtccatcgaaccgtcttctccctgaaaacctgaccctccgtgacccgccgcggacacggtccgtttattccgtgtgcgaggtcgagactggtctttcaatctagnggggccgtggccacccgtggtcactcgtctcctcgacgtctccaccgacggcccagttcccgg

SEQ ID NO: 363316 - DNA, 572 bp, Homo sapiens
  misc_feature: GZ8MTXP02IOANU.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtgacatccattatacgtggggcgacgtactactctccgtccccctacaagacgtctctcacctntttcgaggacacgtccatacgaaccgcttcctccctagaaactcgaccctccgtgaccgccgcgacacggtccgtttattctagtcgcgagggcgagtacgtggttcttcgaacttcgtagtcggggtccggtggcctacccgtcggtctacgtcgtcctcctcgtacgccttacccgaccgtaacggccctacgttccccgg

SEQ ID NO: 363317 - DNA, 601 bp, Homo sapiens
  misc_feature: GZ8MTXP02IKC2T.44.86.H09.1.454.CMB.2.raw
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatcattcgttggggctggatccggcacggccccgagggaggggaatggagtggagttggtgacatccattatacgtggggcacgtactactctccgtcccctacaagacgtcgtctaccacctntttcgagggtaccacgtccagtcgaacccgtcttacctccctagaaactcgaccctccgtacgacccgccggccggacgaccggtaccgttttacttcgtggttcgcgagggccgtagtaccgttggttcttcgaattcgtaggtcggggtccgtggcctaccgtgggtacctacgttcgtacctcccgtaacgcgtccttaccgaaccgtacggccctacgttcccccgg

SEQ ID NO: 363318 - DNA, 540 bp, Homo sapiens
  misc_feature: GZ8MTXP02HS0LY.44.86.H09.1.454.CMB.2.raw
  modified_base (357)..(357): a, c, t, g, unknown or other
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccaggggacggggaatggagtggagttggtgacatccattatactggggcgacgtactactctccgtccccctcaagatcgtntccacntttcgagggacacgtccatcgaacccgcttctccctgaaactcgaccctccgtcgaccgccgccgacacggtcgtttatttctgtgcgtaggcgagactggtcttcaatctagtggggtccgtggccaccgtggtcacgtcgtctctcgacgtccttccacgacggcctactcccgg

SEQ ID NO: 363319 - DNA, 557 bp, Homo sapiens
  misc_feature: GZ8MTXP02HJT1V.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaagtggagtggagttggtgacatcattatacgtggggcgacgtactactctccgtcccctacaagacgtcgtctccacctatttcgaacgggacacgtccatcgaaacccgtcttcctccctagaaactgaaccctcgtcgaccgccgcgacacggtcctttattctgttgcgaggcgagtactggtcttacaatctagtcgggtcgtcggcacccgtggtctacgtcgtccttccctcgtcgtcctaccgaaccgtacggcctacgtccg

SEQ ID NO: 363320 - DNA, 526 bp, Homo sapiens
  misc_feature: GZ8MTXP02H5WO0.44.86.H09.1.454.CMB.2.raw
  modified_base (436)..(436): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtggggaggtccctgagactctcctgtgtagcgtctggattcaccttcaacagacatggcatgcactgggtccgccaggcctccgaggcaaggggctgggagtggggtgccattatagtggtatggatggaaagttaaataatattaatgtagattccgtagaagggccgatcacatctccagagacaattacgaagaacanaactatatctaggaaatagaatagctagagagcgaggacacggctagtctactactgtgcgagaagagtaggggctcggtagatacgaag

SEQ ID NO: 363321 - DNA, 642 bp, Homo sapiens
  misc_feature: GZ8MTXP02JQPA3.44.86.H09.1.454.CMB.2.raw
  modified_base (309)..(309): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagactctcctgtgtagcgtctggattcaccttcaacagacatggcatgccacgtgggtcccnccgaggcctccgaggccgaaaggggctgggaggttggggtgacctagtttatagtggtatggtagtaggtaaaagttaaattaattatttaagtgttaagagtttcccgggtaggaaacggggtaccgtaatttacccgaaccctacttcctacccgaagaacgaacctaaagttaaccgaaagaaacctacaaacttaatatacgtaaggtaaaatagtaaatacgaccgtaggaacgacggaccggaacggacgaacggtcgtacgttacctaacgtacgtagtacgacggaaggaaggtaggtcggggtctacggtaggtaactacgaag

SEQ ID NO: 363322 - DNA, 535 bp, Homo sapiens
  misc_feature: GZ8MTXP02GL05U.44.86.H09.1.454.CMB.2.raw
  modified_base (282)..(282): a, c, t, g, unknown or other
  modified_base (373)..(373): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctggggaggtccctgagactctcctgtgtagcgtctggattcacccttnaacagacatggcatgcacgtgggtccgccaggctcccaggcaaggggctgggagtggggtgcacttatatggtatgatggaaataataatnttatgtagattcgtagaagggcgatcacatctccagacacaattacgaaagaacaacaactaatatctaggaaatagaaatagactagagagaccggaggacgacggctgtctactacgtgtacgcgagaaggagtcgggggtcctggtaggactaacgaag

SEQ ID NO: 363323 - DNA, 570 bp, Homo sapiens
  misc_feature: GZ8MTXP02GV3N2.44.86.H09.1.454.CMB.2.raw
  modified_base (363)..(363): a, c, t, g, unknown or other
  modified_base (497)..(497): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactctccgtcccctcagagtcgtctcaccntttcgagggaccacgtccatcgaacccgtcttctccctagaaacctgaccctccgtcgaccgccgcggacacggtccgtttattcctgtgcgtaggcgagacttggtctttcaatcgtagtggggcctggaccncccgttgggtcctacgttcgtcctcccgtcgacgtcctttacccgaccgaaccgggcccctagtttccccggg

SEQ ID NO: 363324 - DNA, 582 bp, Homo sapiens
  misc_feature: GZ8MTXP02JB3GL.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttccttcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcgacgcccccgaggggaggggaagtggaggtggagttggtgacgatccattatacgtggggcgacgtactactctccgtccccctcaagacgtcgtctcacctcgtttcgaagggaccacgtccatcgaacccgtcttcctccctagaaacctcgtaccctccgtcgaccgcccgacggaccgacggtccgtttatttcgtgtgcgaggcgaggtactggtctttcaattctaggtcgggccgtggcctacccgtggtctacctggtccttcctccgtacgtccttacccaccgaacggccctacgtcccgg

SEQ ID NO: 363325 - DNA, 552 bp, Homo sapiens
  misc_feature: GZ8MTXP02GI491.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggatggagtggattggtgacatccattatactggggcgacgtactactctccgtccccctcaagagtcgtctcacatttcgagggacacgtccatcgaacccgcttctccctgaaactgaccctccgtcgaccgccgcggacacggtccgtttattctgtgcgaggcgagactggtctttcaatctagtcggggccgtggctaccctggtaccacgtcgtccctccgtcacgtcctttacccgaccgtaacgggcccctagttccccgg

SEQ ID NO: 363326 - DNA, 593 bp, Homo sapiens
  misc_feature: GZ8MTXP02HXQUI.44.86.H09.1.454.CMB.2.raw
  modified_base (467)..(467): a, c, t, g, unknown or other
  modified_base (531)..(531): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggcttggatccggcacgcccccgaggggacggggaatggaggtggagttggtgacatccattatacgtggggcgacgtactacctctacccgtccccctcaaacgtcgtaccggttctccaacctgttttcggaacggggtaccaccggttcccagtcgaaacccgtcttcctccctagaaacctcgaccctccgtcgaccgccgcgacncggtctttattctgtgcgtagcgagactggttcttacaagttcgtagtcggggtcgtcggaccncccttgggcctacgtcgtcctcctcgtacgtccttccaaccgacgggtccctagttccccgg

SEQ ID NO: 363327 - DNA, 527 bp, Homo sapiens
  misc_feature: GZ8MTXP02G01EB.44.86.H09.1.454.CMB.2.raw
  modified_base (304)..(304): a, c, t, g, unknown or other
  modified_base (341)..(341): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcaccttcaacagacatggcatgcactgggccncaggctccaggcaagggctgggagtgggtgcacttanagtggtatgatggaaataataatattatgtagattccgagaacgggctattcacatctaccagagacaatacgaaagaacacactatatactaggaaatgaaatagacctagaagacgaccgaggtacgacggctggtacctacgtacgtgtacgacgagaagagtggggctcggtaggatacaag

SEQ ID NO: 363328 - DNA, 596 bp, Homo sapiens
  misc_feature: GZ8MTXP02FYI5B.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgccccgaggggacggggatggagtggagttggtgacatcattagtacgtggggcgtacgtactactctccgtcccctacaacgtagtcgtctacacctgttcggaggtacacgtccagtcgaaacccgtcttcctaccctagaaactcgaaccctccgtcgacccgccgcggaccgcggttaccgtttattcgtggtcgcggtagggcgaacgtcgttacggttctttacgaattcgtaaggtcgggtccgtcggccgtacccgtggtacctcgttcgtcctcctcgacgtccttacccgaccgtacggccctagttccccgg

SEQ ID NO: 363329 - DNA, 720 bp, Homo sapiens
  misc_feature: GZ8MTXP02GQMUF.44.86.H09.1.454.CMB.2.raw
  modified_base (294)..(294): a, c, t, g, unknown or other
  modified_base (308)..(308): a, c, t, g, unknown or other
tcagacagtatatacacgaccggtgctcgatttagtgctatagacttgggtttggggatgctttctgagagtcaaggacctcctgtgcaagaacatgaagcacctgtggtttttccttcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacgccccgaggggagggaanggagtggatttggngacatcctattagtacgtggggactaccgtactactccttcccgtcccccttacgaagtacgtccgtcctacctaaccgtacgttttaccggaaggggtaacctacccgtccgtaacttacggaacccgtcctttcctacccccgtaagtaaacctcgtaacccgttcccggtaccggaccccggccccgaccgggtaccgtacccgggttacccggttttaactttccgggtcggttcgggacccggtacgggggccgtaacggtaccgttgggttaccttttaccgaaagttccgtaagggtccgggggtacccggtcggtacctaccccggttgggtcccacgtttccggtcccttccttcgaacggttcctacccgaaccggtaaccgggtccccacggtttccccgg

SEQ ID NO: 363330 - DNA, 537 bp, Homo sapiens
  misc_feature: GZ8MTXP02IVEMK.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcatcttggggctggatccggcagcccccaggaggggaatggagtggattggtgacatccattatacgtggggcgacgtactactctccgtccccctcaagagtcgtctcacatttcgagggacacgtccatgaaccgcttctccctgaaaactcgacctccgtcgaccgccgcggacacggtccgtttatttcctgtgcgtaggcgagactggtcttcaattctatggggcctggcacccgtggtccactgtcctcctcgacgcttccacctaacgggcccaatcccgg

SEQ ID NO: 363331 - DNA, 589 bp, Homo sapiens
  misc_feature: GZ8MTXP02FXIXZ.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggaggggaagtggaggtggattggtgacatccattatacgtggggcgacgtactactctccgtcccctacaagcgtcgtctccactntttcgagggacacgtccatacgaacccgtcttcctccctacgaaactcgaaccctcccgtcgacccgccggcggaccgaccggttcccgtttatttcgtacgtgccggtacggcgtagacgttggttctttacgaattccgtagtcgggggtccgtggcctacccgttggtccacgttcgtcctcctcacgtccttcccaccgacgggccctacgttccccgg

SEQ ID NO: 363332 - DNA, 680 bp, Homo sapiens
  misc_feature: GZ8MTXP02FSNOP.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtgggcagctcccagatgggtcctgtcccaggtgcagctgcaggagtcgggcccaggactggtgaggccttcgggaaccctgtctctcatctgcactgtctctggtagtttccatcagttctgatctattcttggggctggatcccgggcacggcccccgaggggacggggaagtgggaggtgggtagttggtgactatccattaagtacgtggggcgtacgtactactcctccgtccccctcaagacgtcgtctaccacctgtttcgacgggtacaccgtccagtacgaacccgtcttccgtccctagaaacctcgaaccctccgacgtacccgcccggcggaccgacggtaccgttttacttcgtggtcgcgagggtcgacgtacgttggttccgttttacaaacgttccgtagggttcgggggtacccggtcgggtacccgtaaccccggttggggtaccctaccgtttccggttccttaccccgttcgaaccggttcccctttaccccgaaacccggtaaaccgggggtccccctaacggtttcccccgggg

SEQ ID NO: 363333 - DNA, 601 bp, Homo sapiens
  misc_feature: GZ8MTXP02IF0GT.44.86.H09.1.454.CMB.2.raw
  modified_base (398)..(398): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcagcccccgaggggagggaatggagtggagttggtgacagtccattatacgtggggcgacgtactactctccgtcccctcgaagtacgtcgtctcacctatttcgaggacacgtcccatcgaaccgcttccnccctagaaactcgacctcgtcgaccgccgcgacacggtcctttattcgtgttgccgaggcgagtaccgttggtacttttccgaagttctaaggtcgggggtccgttcgggcctacccgttcgggtacctaccgttcggttcctacccgtctaaccgtcctttacccgaacccgaaacggggtaccccctacgtttcccccggg

SEQ ID NO: 363334 - DNA, 564 bp, Homo sapiens
  misc_feature: GZ8MTXP02ILHA0.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccgacacgcccccaggggaggggaatggagtggagttggtgacatccattatacgtggggcgacgtactactctccgtcccctcaagagtcgtctcacctntttcgaggacacgtccatcgaaaccgcttcctccctagaaactgaccctccgtcgacccgccgcggacacggtccgtttattctgtgcgaggcgagactggtctttcgaattcgtagtcggggtccgtggccacccgtggtacctcgtcgttcctcctaacacgtccttcccaaccgaacgggcccctacgttccccgg

SEQ ID NO: 363335 - DNA, 604 bp, Homo sapiens
  misc_feature: GZ8MTXP02H1WOI.44.86.H09.1.454.CMB.2.raw
  modified_base (370)..(370): a, c, t, g, unknown or other
  modified_base (407)..(407): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcgttgggctggatccggcacgcccccgagggagggaatggagtggagttggtgacatccattatacgtgggcgacgtactactcctccgtccccctacaagtacgtcgtctcacctntttcgaggaccacgtaccagtcgaacccgtcttcccnccctagaaacctcgaccctccgtacgacccgccgccggacgtaccggtccgtttatttctggttcgcggacgggcgagtacgtggttcttacgaacttcgtagtcggggtccgtcggtcctaccgttgggtacctcgttccgtcctccctcgtacgtccttacccgaaccgtaccgggtccctaacgtttcccccgg

SEQ ID NO: 363336 - DNA, 584 bp, Homo sapiens
  misc_feature: GZ8MTXP02IUN5Y.44.86.H09.1.454.CMB.2.raw
  modified_base (372)..(372): a, c, t, g, unknown or other
  modified_base (444)..(444): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcttggggctggatccggcacgcccccgaggggaggggaagtggagtggagttggtgacagtcctattagtacgtggggcgacgtactactctccgtcccctacagtacgtcgtctcaccngtttcgacgggaccacgtccatcgaaccgtcttctcccgtgaaactcgaccctccgtcgaccgccgcggacncggtccgtttatttctgtcgcgaggcgacgtacttggttacttacaattcgtaggtcggggtccgtcggcctaccgttcggtctacgttcgtccttcctcgacgtccttcccgaccgtaacgggccctacgtttccccgg

SEQ ID NO: 363337 - DNA, 565 bp, Homo sapiens
  misc_feature: GZ8MTXP02F1ATC.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcccctcaagagtcgtctcaccntttcgagggacacgtccatcgaaaccgcttctccctagaaactgaccctccgtcgaccgccgcggacacggtccgtttattctgtgcgtaggcgagactcggtctttcaattcgtagtcggggccgttggcctacccgtggtccacgttcgtccttccgtcctacggtccttacccgaaccgtaacgggcccctagtttccccgg

SEQ ID NO: 363338 - DNA, 595 bp, Homo sapiens
  misc_feature: GZ8MTXP02F4Q2V.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggattggtgacatccattatacgtggggcgacgtactactctccgtcccctcacgagtcgtctccaccactttacgagggtacaccgtccgactcgaaccgcttcctccctcgaaactcgacctccgtcgtaccgccgcgacgacgcgttacttctcgtgcgagggcgacgacgtcggttctttacgtactacgtagtcggggtccggttacgggcctacccgtcggtacgtaccgttcggtccttccctcgtaccggtcctttacccacccgtaaacggtcccgtaacgtttcccccgg

SEQ ID NO: 363339 - DNA, 615 bp, Homo sapiens
  misc_feature: GZ8MTXP02IHCZC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggtagtttccatctagttctgatcattcgttggggctggatccggcacgcccccgaggggagggaatggaggtggagttggtgacatcctaattatacgtggggacgtaacgttacctactcctccggttccccctacgtaagacgtcggttctccaacctatttcggaagggaccacgtaccatacgaaacccgtcttcctcccttagaaacctcgtaaccctccgtacgacccgccgaccggacgaccggtaccgttttactttcgtagttcgcgacgggcgaagcttcggtctttcaagttctaggtcggggtccgtggtcctaccgtggtctacgtcgttcctcctcgacgtccttaccgaccgtacggccctacgtttcccccgg

SEQ ID NO: 363340 - DNA, 596 bp, Homo sapiens
  misc_feature: GZ8MTXP02G42EB.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggacggggaagtggagtggagttggtgacatccattatacgtggggcgtacgtactactcctccgtcccctcgagagtcgtctcacctgtttcgagggacacgtccagtcgaaccgtcttcctccctagaaacctcgaccctccgtcgacccgccgcggaccacggtccgtttattcgtgtcgcgtacgggcgtacgtacgttggtacttttacaacttcgtagtcggggccgttcggacctcccgtggtcctacgtcgtcctaccctcgtacgtccttacccgaaccgtaaccgggccctacggtttccccgg

SEQ ID NO: 363341 - DNA, 577 bp, Homo sapiens
  misc_feature: GZ8MTXP02J1FDJ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccaggggaggggaatggagtggagttggtgacatccattatacgtggggcgacgtactactctccgtccccctacaagtacgtcgtctcacctatttcggaacgggaccacgtccatacgaacccgtctttccgtccctagaaaacctcgaccctccgtagacccgccgccggacaccggtccgtttattcctggtgcggagggcgaacgtcgttcggtctttcaattccgtagtcggggccgtgggcacccgtgtacactgtcctccgtcacgccttaccgaccaacggcccacttcccgg

SEQ ID NO: 363342 - DNA, 574 bp, Homo sapiens
  misc_feature: GZ8MTXP02GYVAX.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccaggggacggggatggagtggagttggtgacatccattatacgtggggcgacgtactactcgtccgtcccctcagatcgtctcacntttcgaggaccacgtccatcgaaccgtcttctccctagaaactcgaaccctccgtacgacccgccgccggaccgacggtaccgtttactttctagttgccgagggtcgagacgtggtcttcgaattctagtcggggtctggccacccgttggtacctacgttcgtccttcctcgtacgtccttacccaccgacgggccccacgtttcccccgg

SEQ ID NO: 363343 - DNA, 542 bp, Homo sapiens
  misc_feature: GZ8MTXP02FLZUR.44.86.H09.1.454.CMB.2.raw
  modified_base (366)..(366): a, c, t, g, unknown or other
  modified_base (514)..(514): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaagtggaggtggagttcggtgacatccattatacgtggggcgacgtactactctccgtccccctcagagtcgtctcactnttcgaggacacgtccaatgaacccgtcttctccctagaaacctgaccctccgtcgacccgccgcggaccacggtcctttattctgtgcgaggcgagactggtctttcaattcgtagcggggtcgtggccaccgtggcacgtcgtctcncgagtctccacgacggcccagttcccgg

SEQ ID NO: 363344 - DNA, 520 bp, Homo sapiens
  misc_feature: GZ8MTXP02G1INI.44.86.H09.1.454.CMB.2.raw
  modified_base (375)..(375): a, c, t, g, unknown or other
  modified_base (384)..(384): a, c, t, g, unknown or other
  modified_base (389)..(389): a, c, t, g, unknown or other
  modified_base (402)..(402): a, c, t, g, unknown or other
  modified_base (496)..(496): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttcaacagacatggcatgcacgtgggtcccgccaggcctccgaggcaaggggactggggagtggggtgcacttatagtggtatgatgggaattaatatnttatgtagnttcgngaagggcatcacntctcagcgacaatacgaagaacacactatatcgtaggaaatagaaatagctagagagaccgaggacacggctgactactactgacgcgagaagngtacggggctacggtggatacaag

SEQ ID NO: 363345 - DNA, 563 bp, Homo sapiens
  misc_feature: GZ8MTXP02FXJ82.44.86.H09.1.454.CMB.2.raw
  modified_base (442)..(442): a, c, t, g, unknown or other
  modified_base (481)..(481): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggaggggaatggagtggagttggtgacatccattatacgtggggcgacgtactactcctccgtcccctcaagagtccgtctccacctgtttcgagggacaccgtccagtcgaaccctcttcctccctagaaactcgaaccctccgtcgacccgccgcggacncggtccgtttattctagtgcgaggcgagactggtctttnaatctagcggggtctcggctacccgtggtcacgttcgtcctcctcgacgtccttcccgaaccgacgggccctagttccccgg

SEQ ID NO: 363346 - DNA, 546 bp, Homo sapiens
  misc_feature: GZ8MTXP02HNSSM.44.86.H09.1.454.CMB.2.raw
  modified_base (364)..(364): a, c, t, g, unknown or other
  modified_base (395)..(395): a, c, t, g, unknown or other
  modified_base (500)..(500): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgcccccgaggggacggggaatggagtggagttggtgacatccattatacgtggggcgacgtactactctccgtcccctcaagcgtcgtctcacntttcgaggacacgtccatcgaacccgcttcnccctgaaactgaccctccgtcgacccgccgcgacaccggcgtttacttcgtgtgcgaggcgagactggtctttcaatctagtcgggcgtggccacccgtggtacncgtcgtcctctccgacgtccttcccgacgacggccctattccccgg

SEQ ID NO: 363347 - DNA, 534 bp, Homo sapiens
  misc_feature: GZ8MTXP02JF6Q3.44.86.H09.1.454.CMB.2.raw
  modified_base (395)..(395): a, c, t, g, unknown or other
  modified_base (486)..(486): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgccggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctccagagtcgtctcaccatttcgagggacacgtccatgaaccgcttctccctanaaactgacctcgtcaccgcgcggacacggcctttattctgtgcgagcgagactggtctttcaattctatggggccgtggccaccgtggtcnctcgtctccgtcaagtccttccgaccaacgggccctacgtcggttccc

SEQ ID NO: 363348 - DNA, 543 bp, Homo sapiens
  misc_feature: GZ8MTXP02IHWC4.44.86.H09.1.454.CMB.2.raw
  modified_base (365)..(365): a, c, t, g, unknown or other
  modified_base (401)..(401): a, c, t, g, unknown or other
  modified_base (451)..(451): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggacgtggtgaggccttcgggaaccctgtctctcatctgcactgtctctggagttccatcagttctgatctattcgttgggctggatccggcacgcccccgagggaggggaagtggagtggagttggtgacatcctattatacgtggggcgacgtactactctccgtcccctcaagagtctctcacncgtttacgagggacacgtccatcgaaacccgcttcnccctagaaactcgaccctcgtcgaccgccgcgacacggtcctttatttcngtgcgaggcagtacgtgtcttcaatctagtcgggtccgtgccacctggtcactcgtctccgctcgccttaccacgacggtcctacgtcccgg

SEQ ID NO: 363349 - DNA, 549 bp, Homo sapiens
  misc_feature: GZ8MTXP02I146X.44.86.H09.1.454.CMB.2.raw
  modified_base (360)..(360): a, c, t, g, unknown or other
  modified_base (425)..(425): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtcccctcagagtcgtctcaccntttcgagggacacgtccatcgaaccgcttctccctgaaactcgaccctcgtcgaccgccgcgacncggtccgtttattctgtgcgtaggccgagacttggtctttacaattctagtcggggtcctgggccacccgttggtcacgtcgtctcctcgacgtccttaccaccgaacggcccagtttccccgg

SEQ ID NO: 363350 - DNA, 561 bp, Homo sapiens
  misc_feature: GZ8MTXP02IZ0W2.44.86.H09.1.454.CMB.2.raw
  modified_base (396)..(396): a, c, t, g, unknown or other
  modified_base (402)..(402): a, c, t, g, unknown or other
  modified_base (446)..(446): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccagggagggaatggagtggattggtgacatccattatactggggcgacgtactactctccgtcccctcagagtcgtctcacctatttcgagggacaccgtccatcgaaccgcttctccctnaaactntaacccgtcgtcgaccgcccgcggacacggtcctttatttccgngttcgcgtagggccgagactggttcttacaagttctagtcgggtccgtggccaccgttggtccacgtcgtcctcctcgacgtccttaccgaccaacggggtccctagttccccgg

SEQ ID NO: 363351 - DNA, 553 bp, Homo sapiens
  misc_feature: GZ8MTXP02H61S6.44.86.H09.1.454.CMB.2.raw
  modified_base (369)..(369): a, c, t, g, unknown or other
  modified_base (435)..(435): a, c, t, g, unknown or other
  modified_base (448)..(448): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccccaggactggtgaggccttcgggaaccctgtctctcatctgcactgtctctggatttccatctagttctgatcattcttggggctggatccggcacgcccccgagggaggggaatgggagtggattggtgacatccattatactggggcgacgtactacctctccgtccccctacaagacgtcgtctcacctntttcgagggaccacgtccatcgaaccgtcttctcctagaaactgaccctcgtcgaccgccgcgacncggctttatttcngttgccgaggcgagactggttcttcaatctagtcggggccgtggccaccctggcctacgtcgtcctcctcgacgtccttccgaaccgacgggcccacgttcccgg

SEQ ID NO: 363352 - DNA, 564 bp, Homo sapiens
  misc_feature: GZ8MTXP02GJULZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcagcccccagggaggggaatggagtggagttgggtgacatccattatacgtggggcgacgtactactctccgtccccctcaagagtcgtctcacctatttcgagggacacgtccatcgaaccgtcttctccctgaaactcgaccctcgtcgaccgccgcgacacggtcctttattctgtgccgaggtcgagactggtctttcaattctagtcggggccgtgggcctacccgtggtccacgtcgtcctcctcgacgtcccttaccgaccgtaacgggcccctaacgtttcccccgg

SEQ ID NO: 363353 - DNA, 610 bp, Homo sapiens
  misc_feature: GZ8MTXP02G03J7.44.86.H09.1.454.CMB.2.raw
  modified_base (184)..(184): a, c, t, g, unknown or other
  modified_base (284)..(284): a, c, t, g, unknown or other
  modified_base (350)..(350): a, c, t, g, unknown or other
  modified_base (378)..(378): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtntccagtgtcaggtgaagctggtggagtcgtgggggagcgtggtccagccgtgggagtccctgagactctcctgtgtagcgtctggacttcaccttcaacngacatggcatgcagtcgggtccgcaggcctccgaggcaagggactgggagtggggtgcacgtttanagtggtatggataggaaattaataattnttagtgtaacgagtttaccggaggtaacgggccgtattacccaacctactccctaccgaagaacgaactaaacgttaccgaaacgtaaacaaactaactaataacttacgtaaggaaattaggaaaattacgaccgtaggaacggagaccggaaggaccgacggcttagtacctactacgtggtcgacgaagtaacggtaaggtcgggggacgtacggtaggtaactagaag

SEQ ID NO: 363354 - DNA, 575 bp, Homo sapiens
  misc_feature: GZ8MTXP02HE7AX.44.86.H09.1.454.CMB.2.raw
  modified_base (302)..(302): a, c, t, g, unknown or other
  modified_base (542)..(542): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcacgcccccgagggacgggaatggagtggagttggngacatccattatacgtggggcgtacgtactacctctccgtcccctacaagtacgtcgtctcactgtttcgagggacacgtccagtcgaacccgtcttcctcccttagaaacctcgaacccttccgtacgacccgcgtaccggaccacgggtacccttttatttcgtcgttgcgtagggcgagactggtacttcaatctagcgggccgtggcctacccgtggtctacgtcgtcctccgtcncgtccttccgaccgacggccctacgttccccgg

SEQ ID NO: 363355 - DNA, 597 bp, Homo sapiens
  misc_feature: GZ8MTXP02F9PA2.44.86.H09.1.454.CMB.2.raw
  modified_base (371)..(371): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggaggggaatggagtggagttggtgacatcctattatacgtggggcgacgtactactctccgtcccctcaacgtagtcgtctccacctntttccgagggacaccgtccagtacgaaccgtcttcctccctagaaactcgaaccctccgtcgacccgccgcggaccaccggtccgtttatttcgtgtcgcggtaggcgagtacgtggttctttacaattcgtagtcggggtccgttcggacctacccgtggtcctacgtcgttcctccctcgtacgtcctttacccgaccgtaacgggcccctaacgtttccccgg

SEQ ID NO: 363356 - DNA, 589 bp, Homo sapiens
  misc_feature: GZ8MTXP02HTBGY.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttggggctggatccggcacgcccccgagggaggggaagtggaggtggagttggtgacgtatcctaattatacgtggggcgacgtactactctccgtcccctacacgagtcgtctccactcgtttcggaggactacgtccactcgtaaaccgccttctaccctacgaaacgtcgacccttccgtacgaccgcccggcggacacggtaccgtttacttcgttgttgcgtaggcgagtacgtgtcgtttcaatcgtagtcgggtcgtcggtccaccgtgtccgacgttccgtctcctcgtcgtaccttcccgaccacgggtccctacgtttccccgg

SEQ ID NO: 363357 - DNA, 597 bp, Homo sapiens
  misc_feature: GZ8MTXP02IOM8A.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggacggggaatggagtggagttggtgacatccattatacgtggggcgacgtactactctccgtcccctcaagacgtcgtctcaccntttcgaggacacgtccatgaaacccgcttcctccctagaaactgaccctccgtcgacccgcccgcggaccacggtccgtttatttccgtggttcgccggagggtcgacgacgttcgggttctttacaaattcgtagtcgggggtccgtcggccctacccgtggtcctaccgtcgtcctcctcgacggtccctttacccaacccgtaaacggggcccctaacgtttcccccggg

SEQ ID NO: 363358 - DNA, 528 bp, Homo sapiens
  misc_feature: GZ8MTXP02HA72D.44.86.H09.1.454.CMB.2.raw
  modified_base (387)..(387): a, c, t, g, unknown or other
  modified_base (430)..(430): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcagcccccaggagggaatggagtggattggtgacgatccattatactggggcgacgtactactctccgtcccctcaagagtacgtctcacatttcgaggacacgtccatgaaccgcttcnccctgaaactgacctcgtgaccgcgcgacacgccgtttattcngttgcgaggcgaaactggtctttcaatctagtggggccgtggcacctcggtcactcgtctcctcaacgcttaccgaccaaacggcccacgtcggtccc

SEQ ID NO: 363359 - DNA, 612 bp, Homo sapiens
  misc_feature: GZ8MTXP02F4HJV.44.86.H09.1.454.CMB.2.raw
  modified_base (435)..(435): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttgggctggatccggcacgccccgagggacgggaagtggagtggattggtgacagtccattagtacgtgggcgtacgtactactctccgtcccctacagacgtcgtctcacctgttcgaggacacgtccatgaaccgtcttctccctagaaactgtaccctccgtcgacccgcgacggacncggtaccctttattccgtgttgcgtaacgggcgaacgtacgttcggtactttacgaacttccgtagtcgggggtccgttcgggaccctacccggttggtccgtaaccgtcggttcccttccctaacgtaacggtcctttacccgaaccgtaaccgggtacccctaagtttcccccgg

SEQ ID NO: 363360 - DNA, 572 bp, Homo sapiens
  misc_feature: GZ8MTXP02GTVHJ.44.86.H09.1.454.CMB.2.raw
  modified_base (457)..(457): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtatctattcgttggggctggactccggcacgccccgaggggagggaatggaggtggagttggtgactatcctagttagtacgtggggacgtacggttactacctccttccgtccccctacgaacgtacgtcgtctaccactgtttcgagggtacacgtccatcgaaccgtcttctccctagaaactcgaccctcgtcgaccgcgcgacncgtctttattcgtgtgcgaggcgagtcgtgtcttcatcgtagcgggtacgtggcctaccgtggtctcgtcgtctccgtcgtacgtccttacccacgacggtcctacgttccccgg

SEQ ID NO: 363361 - DNA, 598 bp, Homo sapiens
  misc_feature: GZ8MTXP02HUFT8.44.86.H09.1.454.CMB.2.raw
  modified_base (467)..(467): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcgttggggctggatccggcacgcccccgagggagggaatggagtggagttggtgacagtccattatacgtggggcacgtactactctccgtccccctacaagtacgtcgtctcacctatttcgagggaccacgtacccagtcgaaacccgtcttcctccctagtaaaacctcgaaccctccgtcgacccgccgacggacacggtccgtttattcngtgcgaggcagtactggtcttcgaatcgtaagtcggggtccgtcggtaccacccgttggacctacgttcggtccctaccgtctacggtcctttcccgaacccgtaaacggggcccctaagtttcccccggg

SEQ ID NO: 363362 - DNA, 521 bp, Homo sapiens
  misc_feature: GZ8MTXP02GD3N5.44.86.H09.1.454.CMB.2.raw
  modified_base (284)..(284): a, c, t, g, unknown or other
  modified_base (348)..(348): a, c, t, g, unknown or other
  modified_base (423)..(423): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtggagctggtggagtcgtgggggaggcgtggtccagcctgggaggtccctgagactctcctgtgtagcgtctggattcaccttcaacngacatggcatgcacgtgggtccgccaggctccgaggcaaggggactgggagtgggtgcacttanatggtatgatggaaagtaataatattatgtagattccgtagaagggccgattcacatctcagagacaatcgaaanaacacactatatctaggaaatgaaatagactagagagccgaggacacggctgtactacgtacgtcgtgcgagaagagtggggctggtcggatacgaag

SEQ ID NO: 363363 - DNA, 637 bp, Homo sapiens
  misc_feature: GZ8MTXP02IXVO6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgtgggctggatccggcacgcccccgagggacggggaagtggaggtggagttggagacatccattagtacgtggggacgtacgtactactccgtaccgtcccctacaagacgtcgtctctactacgtttcggaggtaccacgtccagtacgacccgccttctaccctacgtaaacctcgtacccgtccgtaccgacccgcccggacggtaccgtaccggtaccgtttatttccgtagttcggcggagggtacgacgtacgttcggttacttacgaacttcgtaggtcggggtccgtcggtcccgtaccggttcgtaactccgtcgttcctaccgtccgacggtaccttacccgaaccgtacccggtacctacgtttcccccgg

SEQ ID NO: 363364 - DNA, 568 bp, Homo sapiens
  misc_feature: GZ8MTXP02FJKY4.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtcccctcaagagtcgtctcacnttcgagggacacgtccatcgaaccgcttctccctagaaactcgacccttccgtcgaccgccgcggacacggtccgtttattctggtgccgtagggcgacgacgttggttctttcgaattcgtagtcgggggccgttggctaccccgtggtccacttcgtcctccgtcgacggtccttaccacccgaacggggcccctagtttccccgg

SEQ ID NO: 363365 - DNA, 590 bp, Homo sapiens
  misc_feature: GZ8MTXP02GRHCB.44.86.H09.1.454.CMB.2.raw
  modified_base (368)..(368): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacggggaatggagtggagttggtgacatccattatacgtggggcgtacgtactactctccgtccccctcaagagtcgtctcaccntttcgaggacacgtccatcgaaccgcttctccctagaaaactcgaccctccgtcgacccgtccgacgggaccaccgggtcccgttttaatttccgtgttcgacggacgggtccgagtactgggttcttacaagttctagtcggggtcgtcggtccacccgtggtcctacgtcggtcctcctcgacgtccttacccgacgtaacgggccctacgtttccccgg

SEQ ID NO: 363366 - DNA, 610 bp, Homo sapiens
  misc_feature: GZ8MTXP02IC9K6.44.86.H09.1.454.CMB.2.raw
  modified_base (371)..(371): a, c, t, g, unknown or other
  modified_base (402)..(402): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcgttggggctggatccggcacgcccccgaggggagggaagtggagtggattggtgacagtccaattatacgtggggtcgacgtactactctccgtcccctcaagacgtcgtctcacctntttcgaggacacgtccatcgaaccgccttcnccctagaaacctcgaccctccgtcgacccgccgccggacgaccggtccgttttatttcctggttcgcggaggcgacggtacgttcggttcctttacaaagttcgtaggttcgggggtccgtcgggtccaccccgttgggtacctaccgttcggttcctcctccgtagtccctttccaaacccgtaaccgggccctaacgttccccggg

SEQ ID NO: 363367 - DNA, 558 bp, Homo sapiens
  misc_feature: GZ8MTXP02IYMDQ.44.86.H09.1.454.CMB.2.raw
  modified_base (361)..(361): a, c, t, g, unknown or other
  modified_base (425)..(425): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtcccctcaagagtcgtctcaccntttcgacgggacacgtccatcgaaccgcttctccctgaaactgacctcgtcgaccgccgcgacncggtccgtttatttctgttgccgaggcgagactggtcttacaattctagtcggggccgtggcctacccgttggtcacgtcggttcctcctcgacgtcctttcccaacctaacggggcccctaagtttccccgg

SEQ ID NO: 363368 - DNA, 568 bp, Homo sapiens
  misc_feature: GZ8MTXP02HNIGQ.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgagggacggggaatggagtggattggtgacatccattatacgtggggcgacgtactactctccgtccccctacaagacgtcgtctcactntttcgaggacacgtccatacgaacccgcttcctccctagaaactcgaaccctccgtcgacccgccgcggacaccggtcctttattcctgttgcgagggcgagactggtctttcaagttctagtcggggtccgtggcctacccgtggtcctacgtcgtcctcctccgagtcccttaccaccgtaccggccctacgttccccgg

SEQ ID NO: 363369 - DNA, 575 bp, Homo sapiens
  misc_feature: GZ8MTXP02FT5PI.44.86.H09.1.454.CMB.2.raw
  modified_base (369)..(369): a, c, t, g, unknown or other
  modified_base (448)..(448): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggagggatggagtggagttggtgacatccattatacgtggggacgtacgtactactctccgtccccctacagagtcgtctccactnttcgacggactaccgtcatcgaacccgtcttctccctagaaactcgacctcgtcgaccgccgcgacgcgtcgttattcngtgcgaggcgacgacgtcggttctttcgaattcgtagtcggggtccgtggcctacccgtggtacctacgttcgtccttccgtcgtacggtcccttaccaccgtaacgggtcccctacgtttccccgg

SEQ ID NO: 363370 - DNA, 572 bp, Homo sapiens
  misc_feature: GZ8MTXP02GXJAL.44.86.H09.1.454.CMB.2.raw
  modified_base (372)..(372): a, c, t, g, unknown or other
  modified_base (456)..(456): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgaggggacggggaatggagtggagttggtgacatcctattatacgtggggcgacgtactactctccgtccccctcaagacgtcgtctacacctntttcgaggacacgtccatcgaaaccgcttctccctagaaactcgaaccctccgtcgacccgtccgcgacgcgtccgtttattcngtgcgtaggccgtagacgtggtcttcgaatcgtagtcggggcctggcctacccgtggtaccacgttcgtcctccttcgacgtcccttaccaaccgacgggccctacgtttccccgg

SEQ ID NO: 363371 - DNA, 591 bp, Homo sapiens
  misc_feature: GZ8MTXP02G54YE.44.86.H09.1.454.CMB.2.raw
  modified_base (373)..(373): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgcccccgagggacggggaatggagtggagttggtgactatccattatacgtggggcgtacgtactacctctccgtccccctacaagtacgtcgtctcacngtttcgagggtaccacgtccatcgaaaccgtcttcctaccctacgaaactcgaccctcgtcgacccgcgacgacacggtcctttattctgtgcgtaggcgagacgtggttcttacaattcgtagtcggggtccgtcggcctacccgttcgggtactcgtcgtccttccgtcgacgtcccttacccgaccgtaaccgggtcccctaacgtttcccccgg

SEQ ID NO: 363372 - DNA, 574 bp, Homo sapiens
  misc_feature: GZ8MTXP02GGEI0.44.86.H09.1.454.CMB.2.raw
  modified_base (450)..(450): a, c, t, g, unknown or other
  modified_base (504)..(504): a, c, t, g, unknown or other
  modified_base (511)..(511): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgtgggctggatccggcacgcccccgagggagggaagtggagtggagttggtgacatcctattatacgtggggcgacgtactactctccgtcccctacaacgtacgtcgtctcactgttcgaggacacgtccaatcgaacccgtcttcctcctagaaactcgacctccgtcgaccgccgcgaccgacgtcctttattcngtgcgtaggcgagacgtggtcttacatcgtagtcgggccgttcggcctacccgnggttacncgttcgtccgttcctaacgtacgtccttacccgaaccgtaacgggtcccctacgtttccccgg

SEQ ID NO: 363373 - DNA, 586 bp, Homo sapiens
  misc_feature: GZ8MTXP02IG6FI.44.86.H09.1.454.CMB.2.raw
  modified_base (352)..(352): a, c, t, g, unknown or other
  modified_base (368)..(368): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttgggctggatccggcacgcccccgagggaggggaagtggaggtggattggtgacatccattatacgtggggcgacgtactactctccgtccccctanaacgagtcgtctcacntttcgagggaccacgtccagtcgaaacccgcttccctaccctagaaactcgaccctcgtcggaccgcccgacggacgacgtccgtttatttctgtcgcgaggcgagtacgtggtcctttcaacttcgtagtcggggtcccgtcggcctacccgtcggtcctacgttcgttcctcctcgtacgccttacccacccgaacgggcccctagtttcccccgg

SEQ ID NO: 363374 - DNA, 725 bp, Homo sapiens
  misc_feature: GZ8MTXP02J1HMB.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgcccccgaggggaggggaatggaggtggtagttggtgacatcattactacgtggggcgacgtactactctccgtcccctacaacgtagtcgtctccgtactcgttcgagggaccacgtccagtcgaaccgtcctttacctccctagaaacctcgacccgtccggtcgacccggtcccgaccgggtacctaccgggttaccgttttaacgtttccgtaggttcggacgggacggggtaccggtaaagtacccgtttcggggtttaccttttaccgaaaacgtttccgtaaacggggttccggggggttacccggttcggggtacccccgtaacccccggtttcggggttaccccttaaccgttcccggttacccttccccgtaaccgttaaccgtccccgtttaccccgaaaccccggtaaaccgggggtccccctaacggttttccccccggg

SEQ ID NO: 363375 - DNA, 559 bp, Homo sapiens
  misc_feature: GZ8MTXP02H0M6Y.44.86.H09.1.454.CMB.2.raw
  modified_base (305)..(305): a, c, t, g, unknown or other
  modified_base (338)..(338): a, c, t, g, unknown or other
  modified_base (346)..(346): a, c, t, g, unknown or other
  modified_base (372)..(372): a, c, t, g, unknown or other
  modified_base (428)..(428): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagcctgggagtccctgagctctcctgtgtagcgtctggattcaccttcaacagacatggcatgcacgtgggtccnccaggcctccaggcaaggggctgggagtggggngcagttanagtggtatgataggaaagttaatatnttatcgtagtattccgagaacgggccgattccactatctccagagacaatcgaaanaacactatatatacgtaagaaatagaatacgacgtagacgacggacgaacggacgacggtctacgtactacgtacgtcgtacgacggaaggaacggtaggtcggggacgttacggtacggtacgtaacgag

SEQ ID NO: 363376 - DNA, 692 bp, Homo sapiens
  misc_feature: GZ8MTXP02G441G.44.86.H09.1.454.CMB.2.raw
  modified_base (350)..(350): a, c, t, g, unknown or other
  modified_base (416)..(416): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcagcccccgagggaggggatggagtggagttggtgacgatccattatacgtggggcgacgtactactctaccgtccccctanacgtagtcgtctcacctagtttcgagggactacgtcctatcgaaacccgtcttcctaccccgtaanaaccgtacgacccgttcgacccgacccggccggaccggaccgtcccggtttactttaccgttcgtcggttacgacgggtacggtacgtaacgtcggttacggtttccttaacgttaccgttaacggttacggggttcccgggggtccgggttaccgggtaccccttacccgggttcgggtaacccttcgttcccggtttcccttcccggtaacctccgttaccccgttaacccggtaacccggaaacccgggtacccttaccgggttttcccccgg

SEQ ID NO: 363377 - DNA, 622 bp, Homo sapiens
  misc_feature: GZ8MTXP02HLY0I.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacggcccccgaggggacggggaagtggaggtggagttggtgacatcctagttatacgtggggcgtacgtactactctccgtcccctacaagacgtccgtctccactgtttcggagggactaccgtccatacgaaaccctacttcctaccctagaaacctcgtacccttccgtcgacccttccggaccggaccgtaccggttccggttttactttccgtcggttacgcggtacgggcgtacgtacgttcgggttctttacgaattcgtaggtcggggccgtggcctaccgtggtacacgttcgtcctcctaacgcgtccttacccgaccgtacgggccctacgtttccccgg

SEQ ID NO: 363378 - DNA, 562 bp, Homo sapiens
  misc_feature: GZ8MTXP02G3IB8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgcccccgagggaggggatggagtggagttggtgacatccattatacgtggggcgacgtactactctccgtcccctacagagtcgtctcacctgttcgaggacacgtccatcgaaccgtcttcctccctagaaacctcgtaaccctccgtcgacccgcccggcgaccgacggtcctttattctcgtgcgaggcgagacgtggttcttacaattctaggtcgggtcgtcggcctaccgtggtccacgtcgtctcctcgcgtccttccaacgtaccgggcccaagttccccgg

SEQ ID NO: 363379 - DNA, 601 bp, Homo sapiens
  misc_feature: GZ8MTXP02J0S9E.44.86.H09.1.454.CMB.2.raw
  modified_base (413)..(413): a, c, t, g, unknown or other
  modified_base (469)..(469): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggcccttcgggaaccctgtctctcatctgcactgtctctggagtttccatctagttctgatcattcttggggctggactccggcacgcccccgaggggacgggaatggaggtggagttggtgacatccattatacgtgggcgtacgtactactcctccgtccccctcaagacgtcgtctccactatttcggaacgggacctacgtccatcgaaacccgtcttccnccctagaaactcgacccttcggcacccgtccgacgaccacggtccgtttattccgngttgcgagggcgtacgacgttcggttctttacgaattccgtaggtcggggtccgtcggcccaacccgttggtacctcgtcgtcctcgttcgaccgtcttacccgacccgtacgggacccctagttcccccgg

SEQ ID NO: 363380 - DNA, 595 bp, Homo sapiens
  misc_feature: GZ8MTXP02HQ1ZI.44.86.H09.1.454.CMB.2.raw
  modified_base (304)..(304): a, c, t, g, unknown or other
  modified_base (398)..(398): a, c, t, g, unknown or other
  modified_base (407)..(407): a, c, t, g, unknown or other
  modified_base (413)..(413): a, c, t, g, unknown or other
  modified_base (438)..(438): a, c, t, g, unknown or other
  modified_base (561)..(561): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggccccaggactggtgaggccttcgggaaccctgtctctcatctgcactgtctctggagtttccatcagttctgatcattcttggggctggatccggcacgccccagggaggggaatggagtggattggtnacgatcattatacgtggggcgacgtactacctcgtcccgtccccctctaacgagtccgttctccacctagtttccgaggggacctaccgtccangtaacccgntttccnccctgaaactgaccctcgtcgaccnccggcgacgaccgccgtttattcctgttgcgaggccgagacgttcggtctttacacttacgtagtcgggggtccgtcgggtccgaaccccttgggtccctacgtcgttccctcctccggtacncgtttaccccaccaaccgggcccgtacttcccgg

SEQ ID NO: 363381 - DNA, 580 bp, Homo sapiens
  misc_feature: GZ8MTXP02HUB9E.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggctacgccccgagggacgggaatggagtggattggtgacatccattatacgtggggcgacgtactactctccgtcccctcaagagtcgtctcactnttcgaggactacgtcatcgacctcttctcctagaaactgaccctcgtgaccgcgacggactacggtccgttttattcgtgttacgcggtacggcgagtacttgggttctttacgaaattcgtaagtcggggccttggacctacccgtggtaccacgttcgtcctccgtcgtacgtaccttaccgaaccggtaaccggtccctaagtttccccgg

SEQ ID NO: 363382 - DNA, 589 bp, Homo sapiens
  misc_feature: GZ8MTXP02JSDQC.44.86.H09.1.454.CMB.2.raw
  modified_base (245)..(245): a, c, t, g, unknown or other
  modified_base (371)..(371): a, c, t, g, unknown or other
  modified_base (549)..(549): a, c, t, g, unknown or other
tcagacagtatatacacgaccggtgctcgatttagtgctatagacttgggtttggggatgctttctgagagtcaaggacctcctgtgcaagaacatgaagcacctgttggttttttcctcctgctggtggcagctcccagatgggtcctgtcccaggtgcagctgcaggagtcgggcccaggactggtgaggccttcgggaaccctgtctctcatctgcactgtctctggatttccatcagttcngatcattcttgggctggatccggcacggcccccgaggggaggggaatgggagtggagttggtgacgatccattagtacgtggggcgacgtactactctccgtcccctacaagagtcgtctcacctntttcgagggacacgtcactcgaacccgtcttcctccctagaaacctgaccctaccgtcgacccgccgcgacgaccggtccgtttatttcgtgtagcgagggcgacgtacgtggttctttacaagttccgtagtcggggtccgtcgggcctcccggtggtactacgtcggtcctccgtnccgtccttacccgaccgtaacgggccctacgtttccccgg

SEQ ID NO: 363383 - DNA, 581 bp, Homo sapiens
  misc_feature: GZ8MTXP02G3C7E.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtactctcatctgcactgtctctggagtttccatcagttctgatcattcgtggggctggatccggcacgcccccgagggacggggaatggaggtggagttggtgacatccagttatacgtggggcgacgtactactctccgtcccctcaagtacgtctctcacctcgtttcgacggacacgtcatgaacccgcttctaccctagaaacctcgaccctccgtcgacccgccgtacggaccacggtaccgtttagttcgtgtcgcggagggcagacgttggttctttcgaattcgtagtcgggtccgtcgggtcctacccgtggtactccgttcgtcctcctcgacgtcttaccgaccgaacggcccaagttccccgg

SEQ ID NO: 363384 - DNA, 633 bp, Homo sapiens
  misc_feature: GZ8MTXP02JD7MY.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggactccggcacgccccgagggagggaagtggagtggagttggtgactagtccattacgtacgtggggactacgtactactcctccgtccccctacaagtacgtccgtctacacctgtttacgagggaccacgtccagtacgaacccgtcttacctaccctagaaacctcgtaacccgtccgtacgaccccgccggtaccgaccgtaccgttaccggttttattcgtcggttcgacggtacgggcgacggtaccttgggttacctttcgaaactttcgtacgggtcggggtccggtacggccctaccccggttggtcctactcggtcctcctcacgtccctaccgaccgtaacgggtcccacgtttccccg

SEQ ID NO: 363385 - DNA, 597 bp, Homo sapiens
  misc_feature: GZ8MTXP02IN89U.44.86.H09.1.454.CMB.2.raw
  modified_base (352)..(352): a, c, t, g, unknown or other
  modified_base (365)..(365): a, c, t, g, unknown or other
  modified_base (436)..(436): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggattggtgacatcattatacgtggggcgacgtactactctccgtcccctcaagngtcgtctcacctntttcgaggaccacgtccagtcgaaccgtcttcgccctagaaacctcgaccctccgtcgaccgccgcggacncggtcctttattctgtcgcgaggcgagactggttctttacaattcgtagtcgggggtccgtcgggacctaccccgttgggtacctaccgttcgttccttcccgtcgtaacggtccctttaccccgaaccgtaaaccggggtcccctaacgtttcccccggg

SEQ ID NO: 363386 - DNA, 534 bp, Homo sapiens
  misc_feature: GZ8MTXP02FU2UE.44.86.H09.1.454.CMB.2.raw
  modified_base (280)..(280): a, c, t, g, unknown or other
  modified_base (284)..(284): a, c, t, g, unknown or other
  modified_base (306)..(306): a, c, t, g, unknown or other
  modified_base (343)..(343): a, c, t, g, unknown or other
  modified_base (350)..(350): a, c, t, g, unknown or other
  modified_base (368)..(368): a, c, t, g, unknown or other
  modified_base (512)..(512): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttnaacngacatggcatgcactgggtccnccaggctccaggcaagggactggagtgggtgcattanatggtangatggaaagttaataatnttaatgtaagatttccggtagaaaggggccgtattccaccatctaccagagaacaaattcgaaagaacaacactaatatactaggaaatgaaatagacctagagagaccgagacacggctgtactactacgtgtcgcgagaagngtggggctggtaggatacgaag

SEQ ID NO: 363387 - DNA, 705 bp, Homo sapiens
  misc_feature: GZ8MTXP02G2DDT.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggctggactccgggcacggcccccgaggggaggggaagtggaggtggagttgggtgacgtatctaagttatacgtggggaccgtacgtactaccgtccgttccgtccccctacgaagtacgtccgttctaccaaccctagtttccggaacggggtaccaccgtacccgaacgtacggtaaaccccgtctttaccctaccccgttacgtaaaacccgtccgtaaccccgttcccggtaccggaaccccggcccggaccggaccgtaacccgggtttcccggtttttaactttccgttggttcggacggtacgggtaccgtacggtaccgtttcgggtttacctttacgtaaagtttccgtaaggtccgggggtccgttcggacctacccggtggtacctacgttcgtcctcctcgactccgtaccaccgaccggtcccacgttcccg

SEQ ID NO: 363388 - DNA, 580 bp, Homo sapiens
  misc_feature: GZ8MTXP02HDTT1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcttggggctggactccggcacggcccccgaggggacggggaatggagtggagttggtgacatcctattatacgtggggcgacgtactactcgtccgtccccctcgaagacgtcgtctccacctgtttcgagggtacacgtccatcgaaccgtcttcctccctagaaactcgaccctcgtcgaccgccgcggactacggtccgtttatttcctgtcgcgaggtcgagacgttggttcttacaatcgtagtcgggtccgtggcctaccgtggtcacgtcgtcctacctcgacgtcccttaccaccgaaccgggccctacgtttccccgg

SEQ ID NO: 363389 - DNA, 600 bp, Homo sapiens
  misc_feature: GZ8MTXP02HDQ41.44.86.H09.1.454.CMB.2.raw
  modified_base (447)..(447): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggaggggaatgggagtggagttgggtgacatcctaattagtacgtggggcgacgtactactcctccgtccccctcaagagtcgtctcacctgtttcgagggtacaccgtccatcgaacccgtcttcctccctagaaacctgaccctccgtcgacccgccgcgacncggtcctttattctgtgcggagggcgagtacgtggttctttacgaatttcgagttcgggggccgttgggcctacccgtgggtacctacgttcgtccttccctcgtacgtccctttcccgaacccgaacggggtccccctaaggtttcccccgg

SEQ ID NO: 363390 - DNA, 613 bp, Homo sapiens
  misc_feature: GZ8MTXP02GODLK.44.86.H09.1.454.CMB.2.raw
  modified_base (243)..(243): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngatcattcgtgggctggatccggcacgccccgaggggagggagtggagtggattggtgacatcattatagtggggacgtacgtactactcctccgtccccctagaagtagtcgtctaccacctgttcgagggtacacgtccatcgaaccgtcttcctaccctgaaactcgaccctccgtacgacccgccgacgacgtaccggtccgtttattccgtgtgcgagggcgacgtacgttcggttctttacaacgttcgttaacggtcgggggtacccggtcggtacccgtacccgttcgggtacctaccgttcgtcccttcaaccgtacgtccttacccaccggtaaaccgggtaccctacggtttcccccgg

SEQ ID NO: 363391 - DNA, 551 bp, Homo sapiens
  misc_feature: GZ8MTXP02GHKX3.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtgacatccattatacgtggggcgacgtactactctccgtcccctcaagagtcgtctccactntttcgaggacacgtccatcgaaccgtcttctccctgaaactgaccctcgtcgaccgccgcgacacggtcctttattctgtcgcgaggcgagacgtggtcttacatcgtagtcgggccgtggcctaccgtggtctacgtcgtcctcctcgacgtccttaccacgaacgggccctacgtttccccgg

SEQ ID NO: 363392 - DNA, 589 bp, Homo sapiens
  misc_feature: GZ8MTXP02GMWEP.44.86.H09.1.454.CMB.2.raw
  modified_base (206)..(206): a, c, t, g, unknown or other
  modified_base (303)..(303): a, c, t, g, unknown or other
  modified_base (463)..(463): a, c, t, g, unknown or other
  modified_base (479)..(479): a, c, t, g, unknown or other
tcagacagtatatacacgaccggtgctcgatttagtgctatagacttgggtttggggagcttcagctgtggtagagaagacaggattcaggacaatctccagcatggccggcttccctctcctcctcaccctcctcactcactgtgcagggtcctgggcccagtctgtgctgactcagccatcctcagcgtctcgggacccccggnagacggtcacgattcttttgtctggaagtggtccaacatcggaataattacgtatactggtatcggctaatcacaggagccggtccccagacccctnatctagtaggagaatcagccggccctcgacggggtcccctgaccgtattccctacgtcgccctaccaagtcctggccaccctcacgtcccctcccgtggacctatccgagtcggcctccggtcgaggatggaggctagtatttagttcgtgtcgcgggtntggggtactgaacctntccgtagaggtcggacgttcgcttaacggttcgggacgggaacggaacccgaagtccgtacggtacccgtactaagtaccacggacccgaggcctcccgccccgttacgg

SEQ ID NO: 363393 - DNA, 634 bp, Homo sapiens
  misc_feature: GZ8MTXP02FZBVN.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcgacggcccccgaggggacggggaagtggaggtggtagttgggtagactatacctagttatacgtggggtcgtacgtacctactccgtccgtccccctacgaagtacgtcgtctcctactgtttgacggtactaccgtccatacgaacccgtcttcctaccctagaaacctcgtaaccctccgtacgacccgccgacggaccgtaccggttccgtttattcgtgttcgcggaggcgtagacgttcggttctttacaattcgtagtcgggtccgtggcctaccgttcggtaccacgtttcgtcccttacccgcgtaccggtaccttacccgaaccgtaaccgggtccctacggtttcccccgg

SEQ ID NO: 363394 - DNA, 586 bp, Homo sapiens
  misc_feature: GZ8MTXP02GA98C.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgaggggacggggaagtggaggtggagttggtgacatccattatacgtggggcgacgtactactctccgtcccctacagagtcgtctcactntttcgagggacacgtccatcgaaccgcttctccctagaaactcgaccctccgtcgacccgccgcgaccgacgtccgtttattccgtgtgcgaggcgagacgtggtcttacgaatcgtagtcggggtccgtggccgtacccgtgggtacctacgtcgtccttccgtccgtacgtcccgtttacccgaacccgtaacggggtccccaacgtttcccccggg

SEQ ID NO: 363395 - DNA, 757 bp, Homo sapiens
  misc_feature: GZ8MTXP02H70BD.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctcgtggtacgtttccatctagttctgtattctattcgttggggctggacgtccggaccgaccggcccccggaaggggacggggaagtgggaggtaggtagtttggtagactagtcctaagttagtacggtggggacgtacgtaacctactccgtccgtcccctacgaacgtacgtccgtcctccgaaccttacgtttaccgggaacggtacctaccgtacctacgtaccgaaacccgttccctttaccgtaccccgtaacgtaaacccgttaccgtacccccgttaccggtacccggacccggtaccccgggtacccgggtaccgtaacccggggttacccgtttttaacgtttccgttcgggttacggaccgggtagggtaccggtacgtacgttacgggtttacttacgtaaacgttcggtaacgtccgggggtccgtcgggtaaccctcccgttcggtaccttcgtccggttcctcccgttcgcgttccccgtacccggtaaccgaccgggtcccctacgtttcccccgg

SEQ ID NO: 363396 - DNA, 623 bp, Homo sapiens
  misc_feature: GZ8MTXP02JP1FI.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagccccaggagggatggagtggatggtgacatcctattatacgtggggcgtacgtactactcctccgtccccctcacgagtacgtcgtcacctgtttacgacgggacgaccgtcactcgtaaaccgccttctcccctcgaaacctcgacccttaccgtccgaccgacccggcggacccgtaccgggtaccgtttacgtttacgttcgttggtccggacgggcggaacgtacgtcgggttctttaccgtaacttaccgttagtacgggggtccgttggtcccgacccgtcgggtcctaccgtcgtcctccgttcacgtaccttccctaccgaaccggggaccctaccgtttccccgg

SEQ ID NO: 363397 - DNA, 579 bp, Homo sapiens
  misc_feature: GZ8MTXP02GXGE2.44.86.H09.1.454.CMB.2.raw
  modified_base (349)..(349): a, c, t, g, unknown or other
  modified_base (443)..(443): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaacagacatggacatgccacgtgggtccgccaggcctccgaggcaaggggactgggagtggggtgcattanatggtatgataggaaataatatattatgtagtattccggagaaacggggccctattaccaccctatcctaccaagagaactaaattacgaaaanaacaactaataatactagaagtaaatagaatacgacgtagaacgacggacggaacggacgtacggtctagtacctactacgtcgacgacggaggtaacggtaggtcggggtacgtacggtaggtaacgtaacgaag

SEQ ID NO: 363398 - DNA, 665 bp, Homo sapiens
  misc_feature: GZ8MTXP02JTOWG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgagggaggggaatgggagtggagttgggtgacatcctaattagtacgtggggcgtacgtactacctcctccgtccccctcgaagtacgtcgtctacacctcgtttcggacggtaccacgtccagtacgaaccgtccttcctccctagaaacctcgacccgtccggtacgaccccgccgaccgggacccgaccgggttaccgttttaacgtttccgtcggttcggaccggtacggggtacgaggtaaccgttcgggttaccttttacgaaacgttccgtaacggttccgggggtccgttacgggccctacccggttcgggtacctcgtccgtcctcccgtcgtcgtcccttacccgaaccgtaaccggccctaacgtttcccccgg

SEQ ID NO: 363399 - DNA, 639 bp, Homo sapiens
  misc_feature: GZ8MTXP02GULC2.44.86.H09.1.454.CMB.2.raw
  modified_base (275)..(275): a, c, t, g, unknown or other
  modified_base (318)..(318): a, c, t, g, unknown or other
tcagacagtatatacacgaccggtgctcgatttagtgctatagacttgggtttggggagcttcagctgtggtagagaagacaggattcaggacaatctccagcatggccggcttccctctcctcctcaccctcctcactcactgtgcagggtcctgggcccagtctgtgctgacttcagccatcctcagcgtctcgggacccccggcagacggtcacgatcttttgttctggaagtaggtccaacatcggaataattacgtatactggtatcggnaattcacaggagcggtccccagacccctcatctagtagggaanaatcgacggcccggccgtcggtaccggggtccctcggaccgtacttccctctccgccctaccgtaacgtccgtcggccctaccctcgaccgtccccttcccgtcggccctacgtccgacgggtcgggtcccgtcccggggtacgaggtagtcgggacgtcttagtactttacgttcgtggtcggtcggttacgttgggtactacgactcgtcgtagtaggtcggtacgtgtcgttacggtcgggacgggtaacggaacgacgccgtacgtaccgtaccgtaacgtccgacggacccgacggtccctcccggtaccccgtcg

SEQ ID NO: 363400 - DNA, 563 bp, Homo sapiens
  misc_feature: GZ8MTXP02I6T3I.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcttggggctggatccggcagcccccgagggaggggaatggagtggagttggtgacagtccattagtactggggcgacgtactactctccgtccccctcaacgagtcgtctcaccntttcgaggacacgtccatcgaaccctcttcctccctagaaactgaaccctcgtcgaccgccgacggacacggtccgtttaactttcgtgtgtcgagggcgagtactgggttctttacaattctagtcggggtcgtggccaccgtggtctactcgtcctcctcacgtccttaccgaccgaacgggccctacttcccgg

SEQ ID NO: 363401 - DNA, 552 bp, Homo sapiens
  misc_feature: GZ8MTXP02GCTTB.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcacgtgggtccgccaggctccgaggcgaagggctgggagtgggtgcacttatatggtatgataggaaagtaatatattatagtagattccggtagaacgggccgattccacctatcctaccgaagacgaactaagttacgaaaacgaacaacactaatatactaggaaatgaaatacgcctaggacgagaccgagacgacggtctagtctactacgtgtacgcgagaagagtcggggactcggtacgtactacgaag

SEQ ID NO: 363402 - DNA, 622 bp, Homo sapiens
  misc_feature: GZ8MTXP02HAAGM.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctattcgttggggcttggatccggcacgcccccgaaggggagggaatgggagtggagttggagactatcctattagtacgtgggctacggtactactcctccgtccccctagagtagtccgtctccactcgtttacggacggactaccgtacctagtacgtaaacccgtcttaccctcccttagaaacctcgtacccgtacgtcgacccgcccggtcgaaccgtcggtccgtttattccgtgtcgacggagggacgtaggtacgttcggttactttacgattcggtacgtcgggggtccgtcggctaccgtggtacctcgttcgtcctactcgcgtaccttacccaacgtaccggcctacggtttccccgg

SEQ ID NO: 363403 - DNA, 539 bp, Homo sapiens
  misc_feature: GZ8MTXP02ILMHI.44.86.H09.1.454.CMB.2.raw
  modified_base (446)..(446): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgccctcagtgtcgtggggccccagggcaggagggtcagcatctcctgcattgggagcggctcaacaggcggggctaggttttgattgttcatggtacagcaacttccaggaacacgccccaaatgctcatttacgctaacaccattccggccctcgacggggtcccctagacccgtattcctcacggcctccaagtctggccacctcacgccctcctggccatcacgtgggctcgagcctgaggtgtgagctagtatttatactcgccagactatgacgngtagtctgagtgtcgttggggtcgtcgggtcggacgggaccgtaaaggtcgtacccggtcgtaggtctacgaccgacggtccgtacgcccccg

SEQ ID NO: 363404 - DNA, 581 bp, Homo sapiens
  misc_feature: GZ8MTXP02HBDI6.44.86.H09.1.454.CMB.2.raw
  modified_base (372)..(372): a, c, t, g, unknown or other
  modified_base (448)..(448): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctggggctggatccggcacgcccccgaggggacggggagtggaggtggagttggtgacatcctattatacgtggggacgacgtactactctccgtccccctacaagacgtcgtctcacctntttcgaggaccacgtccatcgaacccgtcttcctccctagaaacctcgaaccctccgtcgacccgcccggcggacnccggtccgtttattcgtgtgcgaggcgagacgttggtctttacaattcgtagtcggggtacgtcggcctaccgtggtacctacgtcgtcctcctcgacgtccttacccaccgaacgggccctacgttccccgg

SEQ ID NO: 363405 - DNA, 581 bp, Homo sapiens
  misc_feature: GZ8MTXP02FQTH1.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcacgcccccgaggggaggggaagtggaggtggagttggtgacatccattatacgtggggcgacgtactactctccgtccccctcaagagtcgtctcacctnttcgagggacacgtccatcgaaccgtcttctccctgaaactcgacctccgtgacccgccgcggaccacggtccgtttacttcgtgtgcgaggcgagtactggttctttacgaattcgtagtcggggtccgtcggcctaccccgtggtcctaccgtcgtcctccctcgtacgtccttacccgacccgtaacggggcccctagtttcccccggg

SEQ ID NO: 363406 - DNA, 598 bp, Homo sapiens
  misc_feature: GZ8MTXP02JN640.44.86.H09.1.454.CMB.2.raw
  modified_base (425)..(425): a, c, t, g, unknown or other
  modified_base (563)..(563): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggcccccgagggaggggaagtggaggtggagttggtgacatccattagtacgtggggcgtacgtactactcctccgtcccctacagtagtcgtctctaactgttcgacggacacgtaccactacgaccgtcttcctaccctacgtaaacncgtacccgtcgtcgacccgtccggcgtaccgacggttccgtttatttcgtcggtcgacggacgggacgtacgtacgttcggttacttcgaagttcgtaggtcgggtcgtcgccgtacccgtggtccactcgtcctccncgacgtcctacccgacgaccgtcctacttccccgg

SEQ ID NO: 363407 - DNA, 577 bp, Homo sapiens
  misc_feature: GZ8MTXP02JL17S.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacgggaatggagtggagttggtgacatccattatacgtggggcgtacgtactactctccgtcccctcgaagtagtcgtctccactagtttcgaggtacacgtcagtcgaaccgtcttctccctagaactcgtacctccgtacgacccgccgcgacaccggtccgtttacgttcgtgttcgcgtacgggcgacgtacgtggttcttacgattcgtagtcggggtccgtggtccaccgtggtactcgtcgtcctctcgacgtccttaccgacgtaaccgggccctacgtttcccgg

SEQ ID NO: 363408 - DNA, 783 bp, Homo sapiens
  misc_feature: GZ8MTXP02IKFH5.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagctctctgtgtagcgtctggattcaccttcaacagacatggcatgcacgtcggggtccccgccaggccctcccgaggtaccgaaaggggtacctggggaaggtggggtacggacctaacgtttaagtagttggggtaataggtaagttagggaaaagtttaaaattaagttatttaaagtcggttaaagtacgtttacccggaggtaaacggggccctaatttacccaacccgtattcccgtacccgaaggaacgaaactaaacgttaccggaaaagtaaaccctaaacgtaaccttaaagttaaactttccgtaaaaggggtaaaaattaggtaaaaacgttcggccccgttaaagggaaacggtaccgggacccccggaaaaggggaaacccgtaccggggtaccgtttcgggttaaaccccttaaaaccgttcccggttagggttaccggaaccggggtaaagggggtaagggggttccgggggtaccgttttaccggggaagggggtaaacctttaaacgaacgggttaaacg

SEQ ID NO: 363409 - DNA, 591 bp, Homo sapiens
  misc_feature: GZ8MTXP02IBY0S.44.86.H09.1.454.CMB.2.raw
  modified_base (405)..(405): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggattccatcagttctgatcattcgttggggctggatccggcacgcccccgaggggaggggaatggagtggagttggtgacatcattatacgtggggcgacgtactactctccgtcccctcacgtacgtcgtctaccacctatttcggagggtacaccgtccagtcgaacccgtcttcnccctagaaactcgaccctccgtcgaccgccgacggaccacggtccgtttatttcgtgttcgcgaggcgagtacgtggttctttacaattcgtaggtcggggtccgtggcctacccgttcggtacctctcgttcctcctcgtacgtcctttacccgaaccgtacgggacccctacggtttcccccgg

SEQ ID NO: 363410 - DNA, 627 bp, Homo sapiens
  misc_feature: GZ8MTXP02GT892.44.86.H09.1.454.CMB.2.raw
  modified_base (307)..(307): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacgccccgaggggagggagtggagtggagttggngacatccattagtacgtgggacgtacgtactactcctccgtcccctacgagtacgtcgtctaccactcgttacgacggtacaccgtccagtacgaacccgtccttacctaccctagaaacctcgaacccgtcgtccgaccgcccggacgtaccgaccggttccgttttacttcgtgtcgcgtacgggcgtacgtacgttggttactttacgaacgttcgtaacgggtcggggtccgtcggaccctacccggttgtacctcgtcgttcctccgtcgtaccgtccgttaccgaaccggtaccggtccctacggtttcccccg

SEQ ID NO: 363411 - DNA, 786 bp, Homo sapiens
  misc_feature: GZ8MTXP02HYBCC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgtattctattcgttggggctggacgtccggcacggccccgaggggacgggataggagtggtaagttggtgaacataccaattagtacggtcggggtacgtacgtaactactccgtccgtccccgtactaaagcgtcgttactccgtaacctacgttttccggaagggtaaccctaccgtacctaacgtaccgtaaaccccgtcctttacccgaccccgtttaacgaaacccttaccggtaaccccttccccgggttacgacccccgggaaccccgggtaacccgggtaacccgtaacccggggtttacccgttttttaaacgtttcccggttaggggtttcggtacccggggaacggggtacccggtaaggtaacccggtttcgggtttaccttttaacgaaaaccgtttcgtaacggggtcgggggtcccgtacgggttccgaaccccgtttggggtaccctaccggtcgttccttccccgtcgtaaccgtccccgttacccaacggtaaccccgggtcccttacggtttcccccgg

SEQ ID NO: 363412 - DNA, 559 bp, Homo sapiens
  misc_feature: GZ8MTXP02JA59Z.44.86.H09.1.454.CMB.2.raw
  modified_base (453)..(453): a, c, t, g, unknown or other
  modified_base (523)..(523): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatgggagtggagttggtgacatcctattatacgtggggcgacgtactactctccgtcccctcaagatcgtctcaccatttcgagggacacgtccatcgaaacccgtcttcctccctgaaactgaccctccgtcgaccgccgcgacgacggtccgtttatttcngttgcgaggcgagactggtcttacaatctagtggggccgtggccaccgtggtcctactcgtccttccgtnacgtccttcccgaccgaacgggcccacgtttcccgg

SEQ ID NO: 363413 - DNA, 562 bp, Homo sapiens
  misc_feature: GZ8MTXP02HCIZC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgcccccgagggacgggaatggagtggagttggtgacatccattatacgtggggcgacgtactactctccgtcccctcaagacgtcgtctccgacctgtttcgaggggtacacgtccatcgaacccgtcttcctccctagaaaacctgaccctccgtcgacccgcccgcggaccacggtccgtttatttctgtgcgtaggcgagactggtctttcaatcgtagtcgggccgtcggcacccgtggtcactcgtcctcctcgacgtcttcccaacgaacggcccagtttccccgg

SEQ ID NO: 363414 - DNA, 587 bp, Homo sapiens
  misc_feature: GZ8MTXP02HO9VS.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttgggctggatccggcacgcccccgaggggaggggaatggagtggtagttggtgacatccattatacgtggggcgacgtactactctccgtccccctacgaagcgtcgtctccacctacgtttcgagggtacacgtaccagtcgaaacccgtcttcctccctagaaacctcgaaccctcgtcgacccgccgacggacacggtcctttattctgttgcgaggcgagacgtggttctttcgaattctaggtcggggccgtcgggcctacccgtggtcctacgttcgtcctccgtcgtacgtccttacccaccgaaccggccctacgttccccgg

SEQ ID NO: 363415 - DNA, 677 bp, Homo sapiens
  misc_feature: GZ8MTXP02IHSG0.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcggcccaggactggtgaggccttcgggaaccctgtctctcatctgcactgtctctggatttccatcagttctgatctattcgttgggcttggactccggcacggcccccgaggggagggaagtggaggtggagttggtgacagtcctaagtttgaacttacgtcggggtacgccgttaaccgtcctcgtaccccgtccctacgagtacgtcgtacttcgacctacgttcgtacgacgtccaccgtctacgtacccgtaccttccttaccctacgtaacgtaccgtacccgtcccgttaccggaacccggcccggtccggtaaccgtaccggtaccgtttacgtttcgttcgtcggtccgggacggtccgtacgttaacgtcgtttcgtttacgtaacgttacgttacgtccggggtcccggttacggacccgttacccggctttcggtacctaccgttcgtccgtacccttaccgacgttacccgtccccaaccggtacccggtccc

SEQ ID NO: 363416 - DNA, 559 bp, Homo sapiens
  misc_feature: GZ8MTXP02F5JZS.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctggatccggcacgcccccagggaggggatggagtggagttggtgacatccattatacgtggggcgacgtactactctccgtcccctacacgagtcgtctcactnttcgaggacacgtcatgaaccgtctctccctgaaactgacctccgtcgaccgcccgacggaccacggtccgtttatttcgtgtgcgagggcgacgacgttcggtctttacgaattcgtagtcggggtccgtggcctaccgtcggtccacgtcgtcctctcgtacgccttaccgaccgtaaacggccctagttccccgg

SEQ ID NO: 363417 - DNA, 544 bp, Homo sapiens
  misc_feature: GZ8MTXP02F3UXL.44.86.H09.1.454.CMB.2.raw
tcagacagtatatacacgaccggtgctcgatttagtgctatagacttgggtttggggatgctttctgagagtcaaggacctcctgtgtaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggacggggaatggagtggattggtgacatccattatacgtggggcgacgtactactctccgtcctcaagacgtcgtctcacctatttcgaggacacgtccatcgaaccgtcttcctccctagaaactcgacctcgtcgacccgcgcgacacggtctttagttctgtcgacgtggcgagacgtggtcttcaatctagtggggaccgtcggccaccgtcgtctactcgtcctctcaagtcctacaccgacggccacgtcgttcccg

SEQ ID NO: 363418 - DNA, 561 bp, Homo sapiens
  misc_feature: GZ8MTXP02G6CI5.44.86.H09.1.454.CMB.2.raw
  modified_base (342)..(342): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcacgtgggtccgcaggctccaggcaagggctggagtgggtgcattanatggtatgatggaaattaataattattatgtagtattccggtagaagggtcccgattcaccgatcctccgagacgactaacttacgaaacgaaccacaacttaatacgtctaagggaaaatagaaatacgacctaggaagacggaccggaaggaccaacggctagtacctacgtacgtgtacgcgagtaagaggtcggggctacggtaggactacgaag

SEQ ID NO: 363419 - DNA, 618 bp, Homo sapiens
  misc_feature: GZ8MTXP02GVLJF.44.86.H09.1.454.CMB.2.raw
  modified_base (362)..(362): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggattggtgacatccattatactggggcgacgtactactctccgtcccctcaagacgtcgtctcacntttcgaggaccacgtccatacgaacccgcttcctccctagaaaacctcgaacccttcccgtagacccgccgaacggaccaccggtaccgtttattctgttgacgtagggcgaacgtacgtgggttctttacaaacttcgtaagtcgggggtacccgttcggcctaaccccgtgggtacctaccgttcggttccctccgtaaccgacggtccctttacccgaacccgtaaacggggtccccctaagtttcccccggg

SEQ ID NO: 363420 - DNA, 547 bp, Homo sapiens
  misc_feature: GZ8MTXP02I3JS6.44.86.H09.1.454.CMB.2.raw
  modified_base (361)..(361): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggccccaggactggtgaggccttcgggaaccctgtctctcatctgcactgtctctggagtttccatcagttctgatcattcttggggctggatccggcagcccccagggaggggaatggagtggattggtgacatccattatacgtggggcgacgtactactctccgtcccctcagagtcgtctcacntttcgaggacacgttccatcgaaccgtcttctccctagaaacctcgaaccctcgtcgaccgtccgcgacgacggtccgtttattctgtgcgagggcagactggtctttacaattctagtcggggccgtggccacccgtggtcactcgtctcctcgacgtcttcccgacaacggcccagtttcccgg

SEQ ID NO: 363421 - DNA, 698 bp, Homo sapiens
  misc_feature: GZ8MTXP02HETZA.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgatctattcgttgggctggactccggcacgccccgaggggacggggaatggagtggagttggtgacatcctattatacgtggggctacgtactactcctccgtcccctacaagtcgtcgtctaccacctgtttacgaggaccacgtccatcgaacccgtcttcctccctagtaaactcgtaacccgtccgtacgacccggcccggaccggaccgtaaccgggttcccgttttagtttccgtcgggttcgaccgggtagggaccgtaacggtaccgttcgggttactttacctaaacgttccggttaacggttccgggggtacccgttcggggtacccctaaccccggttcggttcccgtaccgtttccgttccctttaccccgtccgtaaccggtcccctttaccccgaaacccggtaacccggggtcccctaacggttttccccccggg

SEQ ID NO: 363422 - DNA, 651 bp, Homo sapiens
  misc_feature: GZ8MTXP02JV35P.44.86.H09.1.454.CMB.2.raw
  modified_base (364)..(364): a, c, t, g, unknown or other
  modified_base (368)..(368): a, c, t, g, unknown or other
  modified_base (379)..(379): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatcagttctagatctattcttggggctgggactccgggacacggacccccgaggggacggggaatgggagtggattgggtgactatcctattactacgtggggcacgtactactctccgtcccctnaagngtctctcactntttcgaggcacgtccatcgaaccgcttccctcccgtagaaacctcgacccgttccgtcggaacccgccgtacgggacctaccgggttaccgtttttaacttccggtacggtcggtaccggaggggtcgtaaacgtacgtttcgggttacctttacgaatttcccggtaagtcgggggtccgttcgggacctacccgtcgggtacttccgtggttccctccgtaacgtaccgtcctttacccgacccgaacgggtccccacgtttcccccggg

SEQ ID NO: 363423 - DNA, 860 bp, Homo sapiens
  misc_feature: GZ8MTXP02IPGM5.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggtatttccatctagttctgactctattcggttggtcgtggtacgtccggcgaccgcccccggaaggggaacgggtagtagggtaggtggtagggttggtacgacgtactaccgtaagttacgtacgggtacggggaccgtaacggtaccttacctccgttaccccgtacccctacgaacgtacgtccgttcctacctaaccgttcgtttaccgggaacggggtaccctaaccgttacccgtagtaacccgggtaaacccttccctttaccctaccccggtaaacgtaaaacccgttccggtaacccccgtttccgggttacccggacccccggttacccgggggacccgtaacccgggtacccgggttttacccggtttttaacgttttaccggtcggggtttacgggaccgggtaacgggggtaccgtaacgggttaccggtttggggttttacccctttaaagtaaccgtttaacgtttacgggggtaccgggggttacccggttccggtaccccgttaacccggtttcggggtaacccttaccgggtttcttcccccgttcgttaaccacggttacccccttacccgaaaacccgggtaacccggccccgtttaacggtttcccccccggg

SEQ ID NO: 363424 - DNA, 612 bp, Homo sapiens
  misc_feature: GZ8MTXP02JC2IU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggatccggcacgcccccgaggggacggggaagtggaggtggagttggtgacatccattatacgtggggacgacgtactactctccgtccccctcgaagacgtcgtctaccacctagtttcggaagggtaccacgtccaatcgaaaccctcttcctaccctagaaacctcgaaccctccgtcgacccgccggtcgaccgacggtccgtttattcgtgtgcgaggcgaggtactggttctttacaattcgtaggtcggggtccgtcggccgtacccgtggtacctacgtcggtcccttacctcgtacgtcccgttacccgaacccgtaaccggccctacgtttcccccgg

SEQ ID NO: 363425 - DNA, 674 bp, Homo sapiens
  misc_feature: GZ8MTXP02I9XJP.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctcgtggtagtttccattctagttctgtatctattcgttggggctggatccggcacgccccgagggacgggagtggagtggagtggtgacatcattatacgtggggctacgtactactctccgtccctacacgtacgtcgtctccactcgtttcggaggtactacgtccagtacgaaccgtcttcctaccctagtaaacctcgtaccctccggtcgacccggtccgaccggtacctaccgggttccgtttaactttccgtcggtcgtacggacggggtacgtaacggtccgttggggtttacctttacgaacgtttccgtaacgggttccgggggtacccgttcgggtacccgtaaccccggttggttaaccctaccgttcggttccccttacccgtaacgtacgtccctttacccgaacccgtaaaccgggtcccctaacggtttcccccgg

SEQ ID NO: 363426 - DNA, 620 bp, Homo sapiens
  misc_feature: GZ8MTXP02JNF5B.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggactccggcacgcccccgagggacggggaagtggaggtggagttggtgactatccattagtacgtggggcgtacgtactactcctccgtccccctcaacgtagtacgtctcacctntttccggagggaccacgtaccagtcgaaccgtcttcctccctagaaacctcgaacccgttcgtcgaacccgcccgacggaccgaccggtccgttttattcgttcggtcgcggtagggcgtacgtacgttcggttctttacgaattccgtagtcggggtcccgttggcctacccgtgggtcctacgttcggtccctcctcgtacgtcccgttacccgaccgtaacggggtcccacgtttccccgg

SEQ ID NO: 363427 - DNA, 581 bp, Homo sapiens
  misc_feature: GZ8MTXP02HSM4A.44.86.H09.1.454.CMB.2.raw
  modified_base (361)..(361): a, c, t, g, unknown or other
  modified_base (374)..(374): a, c, t, g, unknown or other
  modified_base (443)..(443): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgaggggaggggaagtggagtggagttggtgacatccattatacgtggggcgtacgtactactctccgtcccctacaacgngtcgtctccactntttcgaggacaccgtcatcgaaccgtcttcctccctagaaactcgaccctccgtcgacccgccgcgacncggtctttattctgtgcgaggcgagtctggttactttcgaattcgtagtcggggtccgtcggcctcccgtggttccacgttcgttcctcctcgacgtccctttacccaaccgtaaccgggtccctacgtttcccccgg

SEQ ID NO: 363428 - DNA, 613 bp, Homo sapiens
  misc_feature: GZ8MTXP02GM3O0.44.86.H09.1.454.CMB.2.raw
  modified_base (318)..(318): a, c, t, g, unknown or other
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgccccgaggggagggaatggagtggagttggtgacatccattanacgtggggctacgtactactcctccgtcccctcaagacgtcgtctcaacctntttacgagggtacacgtccatcgaaacccgtcttccgtaccctacgaaaactcgtaacccttccggtcgaaccccgcccggaccggaccgaccgggttaccgtttatttccgtgttcggcggacgggtcgacgtacgtggttcttttacgaacttcgtagtcggggtccgtggcctacccgtggtactccttcgtccttcctcgtcgtccttaccgaacccgaacggtcccacgtttccccgg

SEQ ID NO: 363429 - DNA, 628 bp, Homo sapiens
  misc_feature: GZ8MTXP02HTIJ1.44.86.H09.1.454.CMB.2.raw
  modified_base (347)..(347): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggagtggagtggtagttggtgacagtcattatacgtgggcgtacgtactactctccgtccccncaagacgtcgtctcacctgtttcgggacgacgtaccgtctacgacgtaccgtcttcctaccgtacgtaacgtccgtacccgtccgtaccgacccggccggaccgaccggtaccggtttaccgttttacgtttcgtcggttacggacgggtacggacgtaacgtcgttcggttcttacgttacgttacgtgggtccggggtcgtccggtaccgtccggttcgtacgtcgttcgtccctctaacgcgttaccttacccgacggtacccgcgtacgtttccccg

SEQ ID NO: 363430 - DNA, 596 bp, Homo sapiens
  misc_feature: GZ8MTXP02FJBLP.44.86.H09.1.454.CMB.2.raw
  modified_base (353)..(353): a, c, t, g, unknown or other
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttgggctggatccggcacgccccgagggagggaagtggagtggagttggtgacatccattatacgtggggcgacgtactactcctccgtcccctacaagngtcgtctcactnttcggagggacacgtccatcgacccgtcttctccctagaaactcgacccgtcgtcgaccgccgcgacgacggtcctttattcgtcgtgcgtaggcgagtacgttggttcctttcgaaactcgttaaggtcggggtaccgtcgggcctaacccggttcgttaccacgttcgtccttaccgtcgtacggtaccttacccacccggtaaacgggcccctaacgtttcccccggg

SEQ ID NO: 363431 - DNA, 624 bp, Homo sapiens
  misc_feature: GZ8MTXP02HHU9F.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggccaggactggtgaggccttcgggaaccctgtctctcatctgcactgtctctggtatttccatcagttctgatctattcgttggggctggactccggcacgcccccgaggggacggggaagtggaggtggtagttggtagactatcctaattagtacgtggggacgtacgtacctacttcctccgtccccctacgaagtacgtcgtctccactcgtttcggaacggaccacgtccatacgaaccgtcttacctccctagaaactcaaccctcgtcgaccgccgacggacaccggttcgtttattcgtgttaggcgacgggacgtacgtacgttggttcctttacaaacgttccgtaggtcgggggtccgtcggtccaccggtcggtactacgttcgtccttccgtcgtacgtcccttaccgaaccgacgggtacccctaggtttccccgg

SEQ ID NO: 363432 - DNA, 627 bp, Homo sapiens
  misc_feature: GZ8MTXP02J2G1N.44.86.H09.1.454.CMB.2.raw
  modified_base (478)..(478): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgccccgagggacggggaatggagtggagttggtgacatccattatacgtggggcgacgtactactctaccgtccccctacgaacgacgtcgttctcaccctgtttcgacgggtaccacgtccattacgaaccgctttccgccctagaaaacctcgaaccctccgtcgacccgccgaccgggactaccgggtccgtttattcgtggngtccggagggcgtagtcgttcggttctttacgaattcgtaacggtcggggtcccgtgggtccctacccgtcggtcctaccgtcgtcccttacccgtcgtaccggtcctttacccgaaacccggaaccgggtccctaacgtttccccggg

SEQ ID NO: 363433 - DNA, 583 bp, Homo sapiens
  misc_feature: GZ8MTXP02FX5G2.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcgacgcccccgaggggacggggaatggagtggagttggtgacatccattatacgtggggcgtacgtactactcctccgtcccctacagtagtccgtctccacctntttcgaggaccacgtccatcgaacccgtcttcctccctacgaaactcgtacctccgcgacccgcccggccgacgtacgtccgtttacttcgtcgtgcggtagggcgacgacgttggtcttacgaattcgtagtcggggccgtggcccaccgtgtcctacgtcgtcctccgtctacgtccttaccaccgtaacggccctacgttcccg

SEQ ID NO: 363434 - DNA, 647 bp, Homo sapiens
  misc_feature: GZ8MTXP02IIL9X.44.86.H09.1.454.CMB.2.raw
  modified_base (217)..(217): a, c, t, g, unknown or other
  modified_base (219)..(219): a, c, t, g, unknown or other
  modified_base (222)..(222): a, c, t, g, unknown or other
  modified_base (237)..(237): a, c, t, g, unknown or other
  modified_base (239)..(239): a, c, t, g, unknown or other
  modified_base (241)..(241): a, c, t, g, unknown or other
  modified_base (243)..(243): a, c, t, g, unknown or other
  modified_base (245)..(245): a, c, t, g, unknown or other
  modified_base (248)..(248): a, c, t, g, unknown or other
  modified_base (250)..(250): a, c, t, g, unknown or other
  modified_base (256)..(256): a, c, t, g, unknown or other
  modified_base (258)..(258): a, c, t, g, unknown or other
  modified_base (266)..(266): a, c, t, g, unknown or other
  modified_base (284)..(284): a, c, t, g, unknown or other
  modified_base (287)..(287): a, c, t, g, unknown or other
  modified_base (289)..(289): a, c, t, g, unknown or other
  modified_base (295)..(295): a, c, t, g, unknown or other
  modified_base (297)..(297): a, c, t, g, unknown or other
  modified_base (299)..(299): a, c, t, g, unknown or other
  modified_base (310)..(310): a, c, t, g, unknown or other
  modified_base (342)..(342): a, c, t, g, unknown or other
  modified_base (536)..(536): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctcacactcncnctntctctgtgttctctntntntntntcntntggtgngngtacgcgncccgaccggagggagagnggngngtgtgnancnctatacagggnggactacgtactctctcctccaagacgcgtcnctacacttgtacggacgacctaccgactgtacacccgttcttccaccggtaaacactacccgtacccgttggaccccgccggccggaaccgtaaccgcccggttttactttttacctgtcggtacggacggacggtacgaacgtcggtttacttttccgtaaacgtagtttaccgtggggtccccgggggttcncggtaaaccccctgggttttaccgaaccgttttcggtcctttcccctacgaaccgttacgttccccctaaacccggaaaccgggtaccccgaccttacggtttccccccgg

SEQ ID NO: 363435 - DNA, 640 bp, Homo sapiens
  misc_feature: GZ8MTXP02HMBL7.44.86.H09.1.454.CMB.2.raw
  modified_base (377)..(377): a, c, t, g, unknown or other
  modified_base (406)..(406): a, c, t, g, unknown or other
  modified_base (412)..(412): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatctattcgttggggcttggactccgggcacggcccccgagggaggggaatgggagtggagttggtgacagtcctattagtacgtggggcgacgtactactcgtccgtcccctcaagcgtcgtctcctacngtttcgagggacaccgtacatcgaacccncttccnccctagaaacctcgtaccctccggtcgacccgccggacggaccgtcggttccgtttagtttcgtcggttggcggtacggggcgtaacggtccgttggggttacctttacgtaaacttccggttaaggtccggggggtcccgttgggccctacccgttcgggtacctccgtcgttccctccgtctacggccctttacccgaaccgtaccgggccctacgtttcccccgg

SEQ ID NO: 363436 - DNA, 566 bp, Homo sapiens
  misc_feature: GZ8MTXP02GLV4N.44.86.H09.1.454.CMB.2.raw
  modified_base (307)..(307): a, c, t, g, unknown or other
  modified_base (377)..(377): a, c, t, g, unknown or other
  modified_base (420)..(420): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatctagttctgtatcattcgttggggctggatccggcacgccccgaggggagggatggagtggtagttggngacatcgtattagtacggtggggcgtacgtactactcctccgtcccctacaagtacgtcgtctccacctnttcggacggacacgtccagtacgaacccgtcttcctcccgtanaaacctcgaccctcgcgaccgccgacgactcggtccgtttattctggtgcggaggcagtacgtggttcttcatcgtagtcggcgtcgctaccgtgctcgtcgtctcctaacgcgtacctaccgaccgacggtccctacgtttcccg

SEQ ID NO: 363437 - DNA, 569 bp, Homo sapiens
  misc_feature: GZ8MTXP02HEB8C.44.86.H09.1.454.CMB.2.raw
  modified_base (305)..(305): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcttggggctggatccggcacgcccccgagggaggggatggagtggagttggngacatccattatacgtggggcgacgtactactcctccgtccccctacaagtacgtcgtctcacctctttcgaggaccacgtccatacgaaccctcttcctccctgaaactcgacctcccgtcgacccgtccgcggaccacggtccgtttactttcgtgttgacgaggcgagtacgtgttcttacaatcgtagtcggggtacctcggcaccgtggtctacgtcgtcctctccgactccttccgaacctacgggcctacgttcccg

SEQ ID NO: 363438 - DNA, 582 bp, Homo sapiens
  misc_feature: GZ8MTXP02ISYPN.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaagtggagtggattggtgacatccattatacgtggggcgacgtactactctccgtccccctcaagacgtcgtctcaccntttcgaggacacgtccatcgaaccgcttctaccctgaaactgaaccctcgtcgaccgccgaccggacacggtccgtttactttctggttcgcggagggcgacggtactgggttctttcgaaacttctacgttgggggtccgtcgggtcctaccccgtgggtcctacgtcgtcctccctcgacgtcttcccaaccgaaccgggtccctacgttcccgg

SEQ ID NO: 363439 - DNA, 631 bp, Homo sapiens
  misc_feature: GZ8MTXP02HYD6I.44.86.H09.1.454.CMB.2.raw
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgattctattcgttgggctggatccggcacgccccgaggggagggaagtggagtggagttggtgacatccattatacgtgggacgtacgtactactctccgtcccctcaagacgtcgtctacactntttcgaaggactacgtccatcgaaacccgtcttccctacctagaaacctcgaccctcgtcgaccgacccgccggactaccggtctttactttcgtggtgcgtagggcgtagtacgttcggttcctttacgaagttcgtaggtcgggggtccgtacggtccctacccggttcggtcctaaccgttcggttccctcccgttaaccgacggttacccctttcccgaaacccggtaacggggtccctttccgttaaccccggg

SEQ ID NO: 363440 - DNA, 585 bp, Homo sapiens
  misc_feature: GZ8MTXP02GJLW2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggctggatccggcgacgcccccgagggaggggaactggaggtggagttggtgactatccattagtacgtggggcgtacgtactactccgtccgtccccctcaagcgtcgtctaccactgtttcgaggggacacgtccatcgaacccgtcttctccctagaaactcgaccgtccgtcgacccgccgcgaccgacggtccgtttattcgtgtgcgaggcgagtacgtggttcttacaattcgtagtcggggcctggccaccgttggctacgtcgtcctccgtcgacgtccgttacccgaccgtaccgggtacccacgtttccccgg

SEQ ID NO: 363441 - DNA, 618 bp, Homo sapiens
  misc_feature: GZ8MTXP02H9WPC.44.86.H09.1.454.CMB.2.raw
  modified_base (371)..(371): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatctagttctgatcattcgttggggctggatccggcacgcccccgaggggacggggaatgggaggtggagttggtgacatccattatacgtggggcgacgtactactctccgtcccctcaagcgtcgtctcacctntttcgaggacaccgtccactcgaacccgcttcctccctacgtaaactcgaccctccgtcgacccgcccgacggaccaccgggtcccgtttatttcgtggttcgacgtacgggcgagacgttcggttctttcgtaatcgtagtcggggtccgtcgggcctacccgtgggtacctacgttcggttccctcccgtccgtacgtcccgtttaccccaaccggtaaccgggtcccctaacgtttcccccggg

SEQ ID NO: 363442 - DNA, 691 bp, Homo sapiens
  misc_feature: GZ8MTXP02HN4KQ.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcgaggtgaagctgggtggagtcgtgggggaggcgtggtccagccgtgggacgtcctgagctctcctgtgtagcgtctggattccaccttcaacagacatggcatgcctacgtcggggtccccgccaggcctacccgaagggccgaaaaggggcgtggggaacggtggggtgacctaacgtttatagtagggttatggaagttagggtaaaagttaaaattaaagtttatttaagtacggttaagtacgttttacccgggaaggaaacgggggtaccctaagttaccaacctaacttcccgtacccgaaaggtaacgaaactaaacgtttaaccgggaaaactaaaccaaactaacttaaagttaacttaagtaaggtaaaagtagtaaagtacgaccgtaaggaacggacgaccggaagaacgtacggtcttacgtacctacgttacgttgacgacgaagaagtacggtacggggtctacggtaggtaataacgaag

SEQ ID NO: 363443 - DNA, 574 bp, Homo sapiens
  misc_feature: GZ8MTXP02IT353.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaagtggagtggagttggtgacatcattatacgtggggcgacgtactactctccgtcccctcaagactcgtctcacctgtttcgagggtacaccgtccatcgaaacccgtcttacctccctagaaactcgaccctcgtcgaccgccgaccgcacggtcgtttattcgtgtgcgagggcgagacttggtctttcgaattcgtacgtcggggtccgtggcctacccgtggtccacgttcgtccttcctcctacgtccttaccgaccgtacggaccctacgtttccccgg

SEQ ID NO: 363444 - DNA, 609 bp, Homo sapiens
  misc_feature: GZ8MTXP02IIWXT.44.86.H09.1.454.CMB.2.raw
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcttggggctggatccggcagcccccgagggacggggatggagtggattggtgacatcattagtacgtggggcgacgtactactctccgtccccctacaagagtcgtctcacctntttcgagggactacgtccatcgaaaccgtccttacgtccctagaaactcgaccctccgtcgacccgtcgccggacacggtccgtttatttcgtgtcgcgtagggacgtagacttgggttctttacaaattcgtagtcgggggtccgtaggccacccgttgggtacctacgttcggtccttaccctcgtaacggtccctttaccccgaaccgtaaacgggcccccgtaacgtttcccccgggg

SEQ ID NO: 363445 - DNA, 581 bp, Homo sapiens
  misc_feature: GZ8MTXP02JRCAG.44.86.H09.1.454.CMB.2.raw
  modified_base (363)..(363): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggattggtgacatccattatacgtggggcgacgtactactctccgtcccctcaagagtcgtctcactntttcgaggacacgtccatgaaccgcttcctccctgaaactgaccctccgtgacccgccgcggacacggtccgtttattcgtgttgcgtagggcgaagtctgggttctttcgaattcgtagtcgggggtccgtggccacccgtgggtcctacgtcgttcctccctaacgacggtcccttacccgacccgtaaacggggtcccctaacgtttcccccggg

SEQ ID NO: 363446 - DNA, 568 bp, Homo sapiens
  misc_feature: GZ8MTXP02GT2AO.44.86.H09.1.454.CMB.2.raw
  modified_base (440)..(440): a, c, t, g, unknown or other
  modified_base (457)..(457): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgagggaggggaatgggagtggagttggtgacatccattatacgtggggcgacgtactactctccgtccccctcaagacgtcgtctccacctgtttcgagggaccacgtccatcgaaccgtcttcctccctgaaactcgaccctccgtcgaccgccgcgacncggtccgtttatttcgngtgcgtaggcgagactggtcttcgaatcgtagtcggggtccgttggccacccgttggtctacgtcgtctcctcgacgtccttacccaccgaacgggcccacgtttccccgg

SEQ ID NO: 363447 - DNA, 589 bp, Homo sapiens
  misc_feature: GZ8MTXP02FST02.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaagtgcagctgcaggagtcgggcccaggactggtgaggccttcgggaaccctgtctctcatctgcactgtctctggtagtttccatcagttctgatcattcttgggctggatccggcacgcccccgagggacggggaatggagtggagttggtgacatccattatacgtggggcgtacgtactactctccgtccccctcgaagacgtcgtctacacctgttcgaggacacgtccatacgaaccgtcttctccctagaaaacctcgaccctccgtcgacccgcccgcggacctacgggtcccgtttattccgtaggtgcgagggcgtagacgttgtctttcaattcgtagtcggggccgttgccgacccgtggtccacgttcgccttccgtcgtacgtccttacccgtaaccgacggggtacccccagtttcccccgg

SEQ ID NO: 363448 - DNA, 612 bp, Homo sapiens
  misc_feature: GZ8MTXP02H1CM4.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgccccgagggacggggaatggagtggagttggtgacataccagttatacgtggggacgtacgtacgtacctccgtccgtcccctcaacgagtccgtctcacctgtttccgaggccaccgtaccatacgaacccgtcttcctcccgtagaaacctcgacccttccgtacggaccgccgcgggacacggtcccgttttatttctggttcgcggtaggccgagtacgtggttactttctaagttccgtagtcggggtccgtggtcccacccgttgggtcctacgttcgtcctcccttcgacgttccttacccgaaccgaaccgggtccctacgtttccccgg

SEQ ID NO: 363449 - DNA, 553 bp, Homo sapiens
  misc_feature: GZ8MTXP02IZ022.44.86.H09.1.454.CMB.2.raw
  modified_base (347)..(347): a, c, t, g, unknown or other
  modified_base (359)..(359): a, c, t, g, unknown or other
  modified_base (372)..(372): a, c, t, g, unknown or other
  modified_base (430)..(430): a, c, t, g, unknown or other
  modified_base (442)..(442): a, c, t, g, unknown or other
tcagacagtatatacacgaccggtgctcgatttagtgctatagacttgggtttggggatgcttttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggatttccatcagttctgatcattcttggggctggatccggcagcccccagggaggggatggagtggattggtgacagtccattagtactggggcgacgtactactctccgtcccctcagngtcgtctcaccntttcgagggtacncgtccagtcgaacctcttctccctgaaaactgaaccctccgtcgacccgtcgcggacncggtaccgtttntttctgtgcgaggcgtagacttggtctttcgaattcgtagtcgggggccgtggccacccgtgggtcacttgtcctctcacgtcttacccacgaacggtcccactttcccgg

SEQ ID NO: 363450 - DNA, 659 bp, Homo sapiens
  misc_feature: GZ8MTXP02ITD3G.44.86.H09.1.454.CMB.2.raw
  modified_base (377)..(377): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggactccggcacgcccccgaggggacggggaagtggagtggagttggtgacatccattagtacgtggggcgacgtactactctccgtccccctcgaagtcgtcgtctcacctntttcggaaggaccacgttcccatcgaacccgtcttcctccctagaaacctcgaccctcccgtcgaacccgcccgacggaccgaccgggttccgtttactttccgtgttcggcgtacgggcgtacgtacgttgggtttcctttacgtaaacttcgtaagttcgggggcccgttgggacccgtacccgttgggtccctaacgtttccggttcccttcccgttaacccgtacgttcccgtttaccccgaacccggaaccgggtccccctaacgtttcccccgggg

SEQ ID NO: 363451 - DNA, 569 bp, Homo sapiens
  misc_feature: GZ8MTXP02G8S54.44.86.H09.1.454.CMB.2.raw
  modified_base (533)..(533): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggacgggagtggagtggagttggtgacatccattatacgtggggcgacgtactactctccgtcccctacagtacgtcgtctacactgttcgaggacaccgtcatcgaaccgtcttctccctagaaactcgaaccctcgtcgaccgccgacggacgacgtccgtttacttcgtggtcgcggtaggcgagtacgttggttcttcaattcgtagtcggggtccgtcggacctaccgtggtactacgtcgtcttccncgtacgtccttaccaccgacggccctagttccccgg

SEQ ID NO: 363452 - DNA, 591 bp, Homo sapiens
  misc_feature: GZ8MTXP02GIZ5X.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatcattcttggggctggatccggcacgccccgagggacggggaatggagtggagttggtgacatcctattatacgtggggcgtacgtactactccttccgtccccctacgaagtacgtcgtctccacctgtttcgagggtacacgtccatcgaaccgtcttctccctagaaactcgaaccctccgtcgacccgccgaccggacgtaccggtccgtttattcgtgttcgcgagggcgagtacgttggttctttacgaattcgtaggtcgggccgtggcctaccgtgtccacgtcgtcctccgtcgcgtccttacccgaccgtaaccgggccctacgtttcccccgg

SEQ ID NO: 363453 - DNA, 660 bp, Homo sapiens
  misc_feature: GZ8MTXP02IOYO8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggtagtttccatctagttctgatcattcttggggctggatccggcacgccccgagggaggggatggagtggattggtgacatcattatacgtggggcgacgtactactctccgtcccctcaagacgtcgtctccacctagtttccggacggtaccgtaccgtacctacgtacgtaacccttccttacctcccgttaacgaaaccgtccgtacccgtaccggtcccggacccggcccggtaccggaccgacccgggtttaccgtttacgtttcggtagtcggacggagggtaccgacggtcgttcggtttacttacaagtttcgtaggtccggggtccgtcggtaccctaccggttcggaccttcgttccgttcctccgtaaccgtacgttcccttacccgaaaccgtacccggtacccgtaccggtttcccccgg

SEQ ID NO: 363454 - DNA, 581 bp, Homo sapiens
  misc_feature: GZ8MTXP02F3S7B.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgaggggacggggaatggaggtggattggtgacatcctattatacgtggggcgacgtactactctccgtcccctacaagagtcgtctccacctgtttcgacgggtacacgtccatcgaaccgtcttcctccctagaaactgaccctccgcgtaccgccgcgacacggtctttacttctgtgcgaggcgagacgttggtctttcaattcgtagtcggggccgtggcccacccgttgggtaccacgttcggtccttccgtcgacggtccttcccgaacccgtaacggggcccctagtttcccccgg

SEQ ID NO: 363455 - DNA, 751 bp, Homo sapiens
  misc_feature: GZ8MTXP02GFIG7.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctagtttcgtgggctggacgtccggcgaccgccccggaggggaggagtggaggtaggtagttggtacgactactacctagttaacgtacgggtcggggtacgtaaccgtactacgttcccgttccccgttcccccttaacgaacggtacgttccgttcctacccgtaaccttacgtttaccgggaacgggtacctacccggtacctaacgtaccggaaacccttccttacccgtacccgtaagtaaaccttccgtaacccgttccgaccgaaccccggcccggaccggaaccgtaccggtttaccgttttacgttccgtaggtcggacggtacgggacgtaacgtccgtttggttacctttaacaacgttcggttaggtccgggggtacctcggggtaacccctacccggttcgggtacctaccgttccggtcccttacccgtctaaccggttcccttaacccggaacccggtaaacccggtcccctaacggtttccccccggg

SEQ ID NO: 363456 - DNA, 596 bp, Homo sapiens
  misc_feature: GZ8MTXP02HQYTT.44.86.H09.1.454.CMB.2.raw
  modified_base (358)..(358): a, c, t, g, unknown or other
  modified_base (452)..(452): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttgggctggactccggcacgccccgaggggaggggaatggagtggagttggtgactatacctagttatacgtggggcgtacgtactacctctccgtcccctanaagtctccgtctccactgtttcgacggaccacgtccagtacgaacccgtcttcctccctagaaacctcgacccttcgtcgacccgccgcggacncggtccgttttattcgtggttgcgtaggcgtaagcgttggtctttacgaacgttcgtaggtcggggtccgtcgggtcctaccgttgtacctcgtcgttcctcctaacacgtccttaccgaccgtaacgggccctagttccccgg

SEQ ID NO: 363457 - DNA, 518 bp, Homo sapiens
  misc_feature: GZ8MTXP02F6ZPR.44.86.H09.1.454.CMB.2.raw
  modified_base (284)..(284): a, c, t, g, unknown or other
  modified_base (306)..(306): a, c, t, g, unknown or other
  modified_base (344)..(344): a, c, t, g, unknown or other
  modified_base (458)..(458): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacngacatggcatgcactgggtccncaggctccgaggcaagggctggagtgggtgctacttanagtggtatgataggaaagttaatatattatagtagattccgtggaagggcctattcacatctcagagacatacgaaagaacacactatatactaggaaatagaatagctgaagngaccgagacacggctgtactactacgtcgtagcgagaagacgtgggctcggtgatacgag

SEQ ID NO: 363458 - DNA, 602 bp, Homo sapiens
  misc_feature: GZ8MTXP02IKFRP.44.86.H09.1.454.CMB.2.raw
  modified_base (304)..(304): a, c, t, g, unknown or other
  modified_base (368)..(368): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacgggaatggagtggagttggngacatctaattatacgtggggacgacgtactactcctccgtcccctcaagcgtcgtctacactntttcgaggtacacgtaccatacgaacccgtcttctccctagaactcgaccctccgtgacccgccgaccggactaccggtccgtttatttccgtggttacgcggtacgggcgagtacgttggttacctttcgaaattcgtagtcggggtccgtcgggtaccacccgttgggtcctacgtcgttcctcccgtctacgtcccttacccgaccgtaaccgggccctacgtttccccgg

SEQ ID NO: 363459 - DNA, 593 bp, Homo sapiens
  misc_feature: GZ8MTXP02IMNAJ.44.86.H09.1.454.CMB.2.raw
  modified_base (376)..(376): a, c, t, g, unknown or other
  modified_base (394)..(394): a, c, t, g, unknown or other
  modified_base (554)..(554): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttgggctggatccggcacgacccccgaggggacgggaagtggagtggagttggtgacatccattagtacgtggggacgtacgtactactccgtccgtacccctcgaagacgtcgtctcacctntttcgaggacacgtccancgaaccgtcttccaccctagaaacctcgaccctcgtcgacccgccggcgacaccggtctttacgtttctcggttgacggtaggaccgaggtacttcgggttctttacgacttcgtaggtcggggtccgtcggacctaccgtggtcctacgtcgtccttcncgtcgtacttacccgaaccgacggcccgtacttccccgg

SEQ ID NO: 363460 - DNA, 583 bp, Homo sapiens
  misc_feature: GZ8MTXP02JZG7U.44.86.H09.1.454.CMB.2.raw
  modified_base (349)..(349): a, c, t, g, unknown or other
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacgggaagtggagtggagttggtgacatccattatacgtggggcacgtactactctccgtcccctnaagagtcgtctcacctntttcggaggaccacgtccatacgaacccgtcttcctccctagaaacctcgaccctccgtcgacccggccgcggacacggtccgtttattcgtgtgcgtagggcgagtacgttggttctttcgaattcgtagggtcggggtccgttcggcctaccccgttggtcctcgtcgtccttcctcgacgtccttaccgaccgacgggccctacgtttccccgg

SEQ ID NO: 363461 - DNA, 659 bp, Homo sapiens
  misc_feature: GZ8MTXP02G50TE.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgccccgagggaggggaatgggagtggagttgggtgacatcctattatacgtggggacgtacgtactacctccttaccgtccccctacaagtacgtcgtctaccacctagtttcgacgggtaccaccgtaccatacgaacccgtcttcctaccctagaaacctcgaacccttcccgtcgaccccgccgaccggaaccgtaccggttaccgtttagtttccgtggttcggaccgagggtaccgtaacggtacgttcgggttcttttacgaaagttccgttaaggtcgggggtccgtggcctaccccggtgggttacctacgttcggtccttcccgtaacgtcgtaccctttacccgaacccgtacgggtacccctacgtttccccggg

SEQ ID NO: 363462 - DNA, 631 bp, Homo sapiens
  misc_feature: GZ8MTXP02G6AQX.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggagttttccatcagttctgatcattcgtggggctggactccggcacgcccccgaggggacggggaagtggagtggagttgggtgacgtatccattagtacgtggggcgacgtactactccgtccgtcccctacgaagagtcgtctaccactatttcgaaggaccacgtccaacgtacgaaacccgtcttccgtaccctagaaacctcgaacccttccgacgaccccgcgcggaccgcggttacctttatttcgtgtcgacgagggacgacgtacgttcggttctttacaacgtcgtagtccggggtcgtcgggtacctcccggtggtacctaacgtcggttcccttaccccgtaacgtaccgtacccgttacccgaaccgtaaccggtacccgtaccggttcccg

SEQ ID NO: 363463 - DNA, 560 bp, Homo sapiens
  misc_feature: GZ8MTXP02I7C6M.44.86.H09.1.454.CMB.2.raw
  modified_base (363)..(363): a, c, t, g, unknown or other
  modified_base (381)..(381): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatcattcgttgggctggatccggcacgccccgagggagggatggagtggattggtgacatcattatacgtgggcgtacgtactacctctccgtcccctcaagtcgtcgtctcacctnttcgaggacacgtccacngaccgcttctccctagaaactcgacctcgtcgaccgccgcgacacggtcttattctgtcgacgagcgagcgtggtcttcatcgtagtcgggcgtcggcctacccgtggtacctacgttcgtcctccgtccgacgtcccttacccgaacccgaaccggggtcccctaacggtttccccgg

SEQ ID NO: 363464 - DNA, 575 bp, Homo sapiens
  misc_feature: GZ8MTXP02JH0XE.44.86.H09.1.454.CMB.2.raw
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttgggctggatccggcacgcccccgagggaggggaatggaggtggagttggtgacatccattatacgtggggcgacgtactactctccgtccccctcaagacgtcgtctccacctntttccgagggacctacgtccattcgaaccgtccttctccctagaaacctgaaccctccgtcgaccgtccgcggacacggtccgtttattcgtgtgcgtaggcgagacgtggtctttcaattctagtcggggacctgggcctacccgtggtctaccgtcgtcctacctcgacgtccttaccgaccgaacgggtccccacgtttcccg

SEQ ID NO: 363465 - DNA, 710 bp, Homo sapiens
  misc_feature: GZ8MTXP02JL033.44.86.H09.1.454.CMB.2.raw
  modified_base (355)..(355): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgacggccttcgggaaccctgtctctcatctgcactgtctcgtggtactttccatctagttctgactctattcgttggggctggactccggcacgccccgagggacgggagtggagtggagttggtgacatctattatacgtggggcacgtactctctccgtcccctanagtagtcgtctcactgttcgaggacacgtcagtcgaaccgtcttcctccctagtaaactcgtacccgtcggtaccgacccggcccggacggaccgtaccgggttaccgtttactttccgtagggttcggacggtagggtacggtaacgtaccggttcggtttaccgttttacaaacgtttccgtaacgggttccggggggtaccccgtttacggggaccccgttaaaccccgggttcgggttacccgttaaccggttccgggtttccccttaccccggtcgtaacccggttccccgtttaaccccggaaaccccggtaaaccgggggtcccccttaacggttttccccccggggg

SEQ ID NO: 363466 - DNA, 529 bp, Homo sapiens
  misc_feature: GZ8MTXP02GZM7K.44.86.H09.1.454.CMB.2.raw
  modified_base (430)..(430): a, c, t, g, unknown or other
  modified_base (506)..(506): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagctctcctgtgtagcgtctggattcaccttcaacagacatggcatgcacgtgggtccgccaggcctccgaggcaaggggctgggagtggggtgcacgttatagtggtatgataggaaattaataatattatgtagattcgagaagggcctatcacatctacagacgacaatacgaaagaacanactatatacgtagaaatagaaatagacctagagagaccgagaccgacggctagtctactacgtgtacgcgagaagngtcggggactcggtagactagag

SEQ ID NO: 363467 - DNA, 614 bp, Homo sapiens
  misc_feature: GZ8MTXP02F6TH3.44.86.H09.1.454.CMB.2.raw
  modified_base (373)..(373): a, c, t, g, unknown or other
  modified_base (446)..(446): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggactccggcacgcccccgaggggagggaatggagtggagttggtgactatcctattatacgtggggacgtacgtactactctccgtccccctcaagagtcgtctccactnttcgaggacacgtccagtcgaaccgtcttctccctagaaactcgaaccctccgtcgaacccgccgacggaccncggttccgtttattcgtgtgcgaggtcgagtcttggtctttacgaagttcgtaggtcggggtaccgtgggtacctacccgttgggtacctaccgttcggtcccttcccgtccgtaacggtcccttaccccgaacccggtaaaccgggtccccctacggtttcccccgg

SEQ ID NO: 363468 - DNA, 587 bp, Homo sapiens
  misc_feature: GZ8MTXP02FM517.44.86.H09.1.454.CMB.2.raw
  modified_base (339)..(339): a, c, t, g, unknown or other
  modified_base (460)..(460): a, c, t, g, unknown or other
  modified_base (487)..(487): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggttaggccttcgggaaccctgtctctcatctgcactgtctctggagtttccatcagttctgatcattcttggggctggatccggcacgcccccgaggggaggggaagtggaggtggattgggtgacatccattatacgtggggcgacgtactacnctccgtcctaccagacgtcgtctcacctatttcggagggactacgtccatcgaaccgtccttcctccctagaaactcgacctccgtcgacccgccgacggaccaccggtcgtttagtttcngtcgcggagcgagtaccgtggtcttanaatcgtagtcgggggccgtcgggccacccgttcggtactacgttcgtccgtcctcaacgtccttacccgaccgacgggcccctacgtcccgggttccccc

SEQ ID NO: 363469 - DNA, 602 bp, Homo sapiens
  misc_feature: GZ8MTXP02HOJD4.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttggggctggactccggcacggcccccgaggggacggggaagtggagtggagttggtgactatcctattatacgtgggcgtacgtactactctccgtccccctacaagtacgtcgtctaccactacgtttcgaggacacgtccagtacgaaccgtcttctccctagaaacctcgtacctccgtcgaccgccgcggactacggtccgtttagtttctcgttgcggaggacgtacgacgttgttcttacacgttctaggtcgggtccgtggccctaccgtcggtcctacgtcgttccctccgtccgtacggtcccttaccgaaccggtaccggccctacgtttcccccgg

SEQ ID NO: 363470 - DNA, 610 bp, Homo sapiens
  misc_feature: GZ8MTXP02GNXY3.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggattggtgacatccattagtacgtggggcgtacgtactactctccgtccccctacaacgtagtcgtctccacctatttcggagggacaccgtccaatcgaaaccgtccttactccctagaaaacttcgaaccctccgtcgacccgtccgcggtacaccggttccgtttattctgtagcgaggccgagcgttggtctttcgaattcgtagtcggggtccgtacggcctacccgttgggtcctacgttcggtccttcccgtaaccgtacgtccctttaccccgaaccgaacggggtccccctaacgtttcccccggg

SEQ ID NO: 363471 - DNA, 515 bp, Homo sapiens
  misc_feature: GZ8MTXP02IVLLU.44.86.H09.1.454.CMB.2.raw
  modified_base (307)..(307): a, c, t, g, unknown or other
  modified_base (348)..(348): a, c, t, g, unknown or other
  modified_base (371)..(371): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcacgtgggtccnccaggcctccaggcaaggggactgggagtgggtgcacttanatggtatgatggaaattaatatnttatgtagattcgagaaggcattcacatctcagagacaatacgaagaacacactatatactaggaaatagaatagactagacgagaccgagacacggctgtactactactgtgacgagaagagtcgggctcggaggactacgag

SEQ ID NO: 363472 - DNA, 571 bp, Homo sapiens
  misc_feature: GZ8MTXP02JHESP.44.86.H09.1.454.CMB.2.raw
  modified_base (374)..(374): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagtttccatcagttctgatctattcgttggggctggatccggcacgcccccgagggacggggaatggaggtaggtagttggtgacgatccgattagtacgtggggcacgtactactctccgtcccctacagacgtcgtctcacctntttcgacgggactaccgtctatcgaaccgtcttctccctagaaactcgaacctcgtcgaccgccgcgactcgtcgtttattctgtgcgtaggcgtagacttggttctttacgaatccgtagtcggggaccgttggcctacccgtggtctacgtcgtcctctcgactcctcctaacccgacggtccctacttccccgg

SEQ ID NO: 363473 - DNA, 578 bp, Homo sapiens
  misc_feature: GZ8MTXP02HBDG8.44.86.H09.1.454.CMB.2.raw
  modified_base (438)..(438): a, c, t, g, unknown or other
  modified_base (451)..(451): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggaggggaatggagtggagttggtgacatccattatacgtggggcgacgtactactcctccgtccccctcaagacgtcgtctcacctgtttcgagggacacgtccatcgaaccgtcttcctccctagaaactcgaccctcgtcgaccgccgcggacncgtcgttattcgngtgcgaggcgagactggttcttctaaatcgtaagtcgggggtccgtcggcctacccgtgggtcctacgtcgttcctcctcgtacgtcccttacccgaaccgaaccggggtccctacgtttcccccgg

SEQ ID NO: 363474 - DNA, 683 bp, Homo sapiens
  misc_feature: GZ8MTXP02JKZLA.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtagtttccatcagtttctgatcattcgttggggctggatccggcacgcccccgaggggacgggaagtggagtggagttggtggactataccattagtacgtggggcgacgtactactctccgtccccctacaagacgtcgtctacaccatttcggacggactaccgtcatcgaaaccctcgttcctccctacgaaactcgacccttaccgtcgaacccgtcccgacgggactaccggtaccgtttaatttccgtgtacgtcgaggggtaccgacggtacgttcgggttacctttacgtaaacttcgtaacgggtccgggggaccggttcgggacccgtaaccccgttcgggttaccgtaaccgttcggttacccttcccgtaaccgtaccggtaccctttaccccgaacccggtttaaaacccgggggcccccttaaacggtttccccccgggg

SEQ ID NO: 363475 - DNA, 632 bp, Homo sapiens
  misc_feature: GZ8MTXP02HLU0P.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaacctgtctctcatctgcactgtctctggtatttccatctagttctgatctattcgttgggctggatccggcacgccccgaggggagggaagtggagtggtagttggtgactagtcctaattacgtacggtggggacgtacgtactacctccgtccgtcccctacaagtcgtctctcactgtttcggaggtacacgtccaacgtcgaacccgtcttccgtaccctagtaaacctcgaacccgttccgtacggaccccggcccggacggtaccgtaccgggttcccgttttagtttccgtggtcggtacggacgggtcgacgtacgttcggttctttacaacgttcgtaggtcgggggtccgtcggtcctacccgtggtacctcgtccgtctacctcgtctccgttaccaaccgtccggacctacgttccccgg

SEQ ID NO: 363476 - DNA, 633 bp, Homo sapiens
  misc_feature: GZ8MTXP02JNVO1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtatctattcgttggggtctgggactccggcacggcccccgaaggggacgggaagtggaggtggagttggtagactagtcctattagtacgtggggcgtacgtactactctccgtcccctacaagtacgtcgtctacacctgtttcgaggacaccgtaccatacgaaccgtcttcctacccgtagtaaactcgaccctcgtcgaccgtcccgacggacctaccgggttccgtttactttcgtacgtcgcggacgggtcgtaacgtcgttcggttactttactaaacgttcgttagtcgggggtccgtcggccctacccggttgtaccgtacgttcgttcctccgtcgtacgtccttacccgacgaaccggtccctacgtttccccgg

SEQ ID NO: 363477 - DNA, 669 bp, Homo sapiens
  misc_feature: GZ8MTXP02JLRVS.44.86.H09.1.454.CMB.2.raw
  modified_base (381)..(381): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatcattcgttggggctggatccggcacggcccccgaggggacggggaagtgggaggtggagttggtgactatcctaattacgtacgtggggcgtaacgtactactccgtccgtcccctacaagcgtcgtctcactntttcgacggacacgtcatcgaaaccgtcttactccctagaaactgaaccctccgtcgacccgtccgacggaccgtaccgggttacccgtttagtttccgtcggtacggtcggtacgggtaccggtaggttaaccgtggggtttccttttacgtaaacgttccgttaagggtcgggggtaccgttcggggaccctaaccccggttgggttaccctacgttcggttaccctcccgttcgtacggtccctttacccgaccgtaaccggggcccctaacggtttcccccggg

SEQ ID NO: 363478 - DNA, 558 bp, Homo sapiens
  misc_feature: GZ8MTXP02H4UTM.44.86.H09.1.454.CMB.2.raw
  modified_base (268)..(268): a, c, t, g, unknown or other
  modified_base (285)..(285): a, c, t, g, unknown or other
  modified_base (310)..(310): a, c, t, g, unknown or other
  modified_base (439)..(439): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggagcgtggtccagccgtgggacgtccctgagactctcctgtgtagcgtntggattcaccttcaacngacatggcatcgcacgtcgggtccncgaggcctcgaggcgaagggctgggaggtgggtgctacgttatgtggtatgagtaggaaagttaatatattagtagtagtacttcggagaacgggctataccacctatcctcaagacactaatacgaanaacactaatactatactaaggaatacgaaatcgactagaacgacgcgaaggacgacgcttacgtactacgtacgtgtacgacggagtaagcggtacgggtcgtaggtagaactacgaag

SEQ ID NO: 363479 - DNA, 590 bp, Homo sapiens
  misc_feature: GZ8MTXP02JMQZ2.44.86.H09.1.454.CMB.2.raw
  modified_base (367)..(367): a, c, t, g, unknown or other
  modified_base (441)..(441): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatcagttctgatcattcttggggctggatccggcacgcccccgagggagggaatggagtggagttggtgacatccattatacgtggggcgacgtactactcctccgtcccctcaagacgtcgtctcaccngtttcgagggacaccgtccagtcgaaacccgtcttcctccctagaaactcgtaccctcgtcgaccgccgcgacncgtcgtttattcgtgttgcgaggcgagacgtcggttactttcgaattcgtacgtcgggggtccgtcggccgtacccgttgggtacctaccgtcgttcctacctccgtacgtccctttaccgaccgacggggtacccacgtttcccccgg

SEQ ID NO: 363480 - DNA, 597 bp, Homo sapiens
  misc_feature: GZ8MTXP02H741A.44.86.H09.1.454.CMB.2.raw
  modified_base (410)..(410): a, c, t, g, unknown or other
tcagacagtatatacacgaccggtgctcgatttagtgctatagacttgggtttggggatgctttctgagagtcaaggacctcctgtgcaagaacatgaagcacctgttggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttgggctggatccggcacgccccgaggggacggggaatggagtggagttggtgacatccattatacgtggggacgacgtactactcctccgtccccctacaagacgtcgtctcacctagtttcgaaggacacgtccatcgaaacccgtcttccnccctagaaacctcgaaccctccgtcgacccgccgaccggactaccggtccgtttattccgtgtcgcgtaggccgagtacgttggtctttacaattcgtagtcggggtccgtggccacccgtggtacctacgtcgtcctcctcgtacgtccttacccgacccgtaacggtccctaacgttcccccggg

SEQ ID NO: 363481 - DNA, 562 bp, Homo sapiens
  misc_feature: GZ8MTXP02GME1B.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggaggggaatggagtggagttggtgacatccattatacgtggggcgacgtactactctccgtccccctcagagtcgtctcacctntttcgagggacacgtccatcgaacccgtcttcctccctagaaactcgaccctccgtcgaccgccgcggaccacggtccgtttatttctgtgcgaggcgacgtacgtggtctttcaattcgtagtcggggtccgtggcctacccgtggtccacgtcgtcctcctcgcgtccttcccaccgaacggccctagttccccgg

SEQ ID NO: 363482 - DNA, 558 bp, Homo sapiens
  misc_feature: GZ8MTXP02HX32H.44.86.H09.1.454.CMB.2.raw
  modified_base (357)..(357): a, c, t, g, unknown or other
  modified_base (369)..(369): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgcccccgaggggacggggaatgggagtggtagttggtgacatccattatacgtggggcgacgtactactctccgtcccctcaagngtcgtctcactntttcgaggacacgtcatcgaaccgtcttctccctagaaactcgacctcgtcgaccgccgcgacgacgtccgtttatttcgtgtcgcgtaggcgagacttggttctttcaatctagtcggggcctggcctaccgtggtctacgtcgtcctcgttcacgtccttcccaccgtaacggccctagttccccgg

SEQ ID NO: 363483 - DNA, 735 bp, Homo sapiens
  misc_feature: GZ8MTXP02HCTJR.44.86.H09.1.454.CMB.2.raw
  modified_base (284)..(284): a, c, t, g, unknown or other
  modified_base (308)..(308): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtccctgagctctcctgtgtagcgtctggattccaccttcaacngacatggcatgcacgtgggtcccnccaggcctaccgaggccgaaaggggctggggaggtggggtgcctaacgtttagtagtgggtataggagttagggtaaaagttaaaattaaagttattttaaagtacggttaaagtacgttttacccgggagggtaaaaccggggtcccgtaaatttacccaaccctagttacccttacccgaaagtacgtaaacctaaaacgtttaccgaaaacgaaacctaaacctaaaccttaaataacgtttaccgtaaagggtaaaacttaggtaaaatacggtacccgttaggaaacggacgggaacccggaaacgggaaccgtaaccgggtccgttacggttaaccttaacgttaaccgttggtaccggacggtaaacgggaacggtaagggtcgggggtaccttaccgggtaggtaacgttaacgaaagg

SEQ ID NO: 363484 - DNA, 570 bp, Homo sapiens
  misc_feature: GZ8MTXP02HOO75.44.86.H09.1.454.CMB.2.raw
  modified_base (354)..(354): a, c, t, g, unknown or other
  modified_base (392)..(392): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggccgtgggagtccctgagactctcctgtgtagcgtctggattcaccttcaacagacatggcatgcacgtgggtcccgccaggcctccgaggcaaaggggctggggagtggggtgctatttanagtggtatgagttaggaaagttaaattaattatttaangttaagtatttaccggaggaaacgggccgtattccgaccactctccagacgaacaattacgaaagaacacacttaatattacgtagaaatagaatagcctagagacgacgagacgacggctacgtctactacgtgtcgacgaggaacggaggtcggggtctcggtaggtactagtaag

SEQ ID NO: 363485 - DNA, 571 bp, Homo sapiens
  misc_feature: GZ8MTXP02IT1MX.44.86.H09.1.454.CMB.2.raw
  modified_base (449)..(449): a, c, t, g, unknown or other
  modified_base (465)..(465): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgtatctattcgttggggctggatccggcacgcccccgaggggagggatggagtggagttggtgactatctattatacgtggggacgacgtactactctccgtccccctacgaagacgtcgtctacctacctgtttcgaggtacctacgtccagtacgaccctcgttcctccctagaaactcgaaccctcgtcgaccgccgcgacncggtccgtttattcgngtcgacgaggcgagtcgtggttcttacaatcgtagcggggtcgtcggcctaccgtcggtctcgtcgtcctctcgacgtcttaccacgaccggccacgtttccccgg

SEQ ID NO: 363486 - DNA, 561 bp, Homo sapiens
  misc_feature: GZ8MTXP02HIVHT.44.86.H09.1.454.CMB.2.raw
  modified_base (373)..(373): a, c, t, g, unknown or other
  modified_base (455)..(455): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcagcatctcctgcattgggagcggctccaacagcggggcaggttttgatgttcaatggtaccagcaacttccaggaacagcccccaaatgctcatttacgctaacaccattccggccctcgacggggtccctgaccgattctcaggctccaagtctggccactcacgccctcccnggccatcacgtcgggctcgaggctgaggatgaggctagtatttagttactcgcctacgtaccctagtcgacagtacgtctgngtggtcgttggggtagttccgggagggaacgggtaccgaaaggggttccgaacccggttcgtaacgggtcccacggtacccgaacgggccgttacccgccccccgg

SEQ ID NO: 363487 - DNA, 589 bp, Homo sapiens
  misc_feature: GZ8MTXP02HVQQL.44.86.H09.1.454.CMB.2.raw
  modified_base (371)..(371): a, c, t, g, unknown or other
tcagacagtatatacacgaccggtgctcgatttagtgctatagacttgggtttggggatgctttctgagagtcaaggacatcctgtgcaagaacatgaagcacctgtggtttttcctcctgctggtggcagctcccagatgggtcctgtcccaggtgcagctgcaggagtccgggcccaggactggtgaggccttcgggaaccctgtctctcatctgcactgtctcgtggtagtttccatcagttctgatctattcgtgggctggactccggcacgcccccgagggaggggaagtgggagtggattggtgacatcctattatacgtggggacgacgtactactcctccccgtcctacagtagtcgtcctcncctagtttcggagcctacgtcatcgacccgtcttcctccctagaaactcgaccgtccgtacgcccgccgcgacaccggttccgttttattcgtgtcgcggtaggcgtagtacttcggtctttacgaacttcgtaggtcgggggtccgtcggcctacccgttcggtccacgttcgtccttcccgtcacgtccttcccgaaccgtaccggtccctaccgg

SEQ ID NO: 363488 - DNA, 535 bp, Homo sapiens
  misc_feature: GZ8MTXP02I979Q.44.86.H09.1.454.CMB.2.raw
  modified_base (207)..(207): a, c, t, g, unknown or other
  modified_base (228)..(228): a, c, t, g, unknown or other
  modified_base (302)..(302): a, c, t, g, unknown or other
  modified_base (430)..(430): a, c, t, g, unknown or other
  modified_base (449)..(449): a, c, t, g, unknown or other
tcagacagtatatacacgaccggtgctcgatttagtgctatagacttgggtttggggagcttcagctgtggtagagaagacaggattcaggacaatctccagcatggccggcttcccctctcctcctcaccctcctcactcactgtgcagggtcctgggcccagtctgtgctgactcagccatcctcagcgtctcgggacccccggnagacgtcacgatcttttgtcnggaagtagtccaacatcggaataattacgtatactggtatcggcaaattcacaggagcggtccccagacccctnatcataggagaatcagccggccctcgacggggtccctgaccgtattccctctgcctccaagtctggccacctcacgcctcccgtggccatcaggtcggcgtccggtccgagatcgagctgattattcngtgcggtatgggatgacgntccgtgagtggactgctacgtcggcgggacgggaccaaagcgtacgacccgtactaaagtcacgcccgaagcctcgccccctccgg

SEQ ID NO: 363489 - DNA, 674 bp, Homo sapiens
  misc_feature: GZ8MTXP02F51HU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgtggggctggacgtccggcacgccccggagggaggggaagtggaggtggagttggagacactcctattagtacgtggggacgtacgtactactctccgtacccctacgaagtacgtcgtctccactgttcggaggacctacgtccactacgaacccgtcttcctaccgtacgaaacctcgtaacccgtccgtacgaccccggtcccggaccggacccgtaccgggttcccgtttttaacgtttccgttcggttcggacgggtacgggtaccgtaacgtacgtttcggtttacctttacgaacgttccgtaggtcgggggtccgtacggtcccgtacccgttcgggtacctacgttcgtccttcctaaccgtacgtcccgttacccaacccggtaaccgggtcccctaacggtttcccccgg

SEQ ID NO: 363490 - DNA, 579 bp, Homo sapiens
  misc_feature: GZ8MTXP02IHFAE.44.86.H09.1.454.CMB.2.raw
  modified_base (371)..(371): a, c, t, g, unknown or other
  modified_base (405)..(405): a, c, t, g, unknown or other
  modified_base (411)..(411): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgaggggacggggaatggagtggagttggtgacatctattatacgtggggcgacgtactactctccgtcccctacagacgtcgtctacacctntttcgagggtacacgtccatcgaaaccgtcttcnccctanaaactgaccctcgtcgacccgccgcgacgacgtccgtttatttcctgtgcggtaggcgtagacttggttctttcattctagtcgggggtccgtaggcctaccgttggtcctacgtcgttctcctcgtacgtccttacccaccgaacgggtcccctagtttcccccggg

SEQ ID NO: 363491 - DNA, 749 bp, Homo sapiens
  misc_feature: GZ8MTXP02I6OOS.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtatttcatctagttctgatctattcgttggggctggactccggcacgcccccgaggggacgggagtggtaggtggtagttggtcgacagtacctagttagtaacgtggggaccgtaaccgtacttacctccgttcccgtcccctacgaagtacgtccgtctaccacctacgtttcggacgggacctaccgtcctaagtcggtaaaccctcttccctaccctagaaaaccgtcgaacccgtccgtacgacccgtcccggcggaccgtaccggttaccgttttacgtttccgtcggtacggacgtacggggtaccgtaaacggttccgttaggggtttacctttaacgtaacgtttaccggttaaacgggttccgggggtaccggttaccgggtacccgttaccccggttacggggttcccctaacgtttcccggttaccttccccgtaacccgttaccggtccctttaacccccgaaacccggttaacccggggtcccccgtaaaacggttttccccccgggg

SEQ ID NO: 363492 - DNA, 609 bp, Homo sapiens
  misc_feature: GZ8MTXP02GUBUC.44.86.H09.1.454.CMB.2.raw
  modified_base (496)..(496): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacgcccccgaggggagggaagtggagtggagttggtgacatcctattagtacgtggggcgtacgtactacgtccttccgtcccctacacgtagtccgtcctccactgtttccgaacggggtaccaccgttaccaagtcgaaacccgtccttccctcccgtagtaaacctcgtaaccctcgtccgaccgccgacgacctcgggtcctttattcgtgtgcggacggngacgtacgttggttacttcaatcgtaggtcgggtcgtggtcctacccgttggtacctacgtcgttcctccgtaacacgtccttaccaccgaaccggtccctacgtttccccgg

SEQ ID NO: 363493 - DNA, 785 bp, Homo sapiens
  misc_feature: GZ8MTXP02ILJ8T.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcactgtctctggatttccatctagttctgatctattcgttggggctggatccggcacgccccgaggggagggaatggagtggagtttggtgactatcctagttatacgtggggacctacggttactaccctccgtcccgtccccctacaacgtacgttccggttactcctaacccgtacgttttccggaacggggtaacccacccggttacccaacgtacggaaacccgttcctttaccgttacccccgttaaggtaaaaaccttcccggtaaaccccgtttccccggtacgggtaacccccggccccgggtaaccggggtaaccccgtaaccgggggttaccccggttttttaaacgtttccgttcgggtttaccgggaccgggttaacggggacccgtacggtaacccggttgggtttccttttaaccgaacgttcgttaaacggtcgggggtaccccgtgggtcccgtaaaccccggttggtccgtacgttccggtccctttcccgcgtaaccggtaccctttaccccgaaccggtaaccggggtaccccctaaggtttccccccgg

SEQ ID NO: 363494 - DNA, 725 bp, Homo sapiens
  misc_feature: GZ8MTXP02IJBBJ.44.86.H09.1.454.CMB.2.raw
  modified_base (286)..(286): a, c, t, g, unknown or other
  modified_base (353)..(353): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattcaccttcaaacngacatggcatgcacgtgggtccgccaggcctccgaggcaaggggactgggagtggggtgctacttanagtggtaatggaataggtaaattaaataattatttaagtgttaagtaacgtttccggtaagggtaaacgggggtaccgtaaagtttacccaacccgtaattacccgttacccgaaaggaaacgtaaacgtaaaacgtttaaccggaaaaacgaaaacctaaacctaaaaccttaaacttaaatttaaccgtaagggtaaaaattaaggtaaaagttaacgacccgttaaggaacggtaaacggacccgggaaacgggaaaccgtaaccgggacgttacggttaaccttaaaccgttaacgttacggttacggacggaaggtaaggtaaggtacgggggtacgttaccgggtaggtaaacgttaacgtaaagg

SEQ ID NO: 363495 - DNA, 601 bp, Homo sapiens
  misc_feature: GZ8MTXP02I9XUB.44.86.H09.1.454.CMB.2.raw
  modified_base (528)..(528): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggagtttccatctagttctgatcattcgttggggctggatccggcacggcccccaggggacggggaagtggagtggagttggtgacatccattatacgtggggcgtacgtactactctccgtcccctcaagtacgtcgtctcacctgtttcgacgggtacaccgtcagtcgaaccgtcttctccctgaaactcgacccttcgtcgacccgccgtcgggacctacggtccggtttattcgtgttgcggtaggccgtaagcgttggttctttacaattccgtaggttcggggccgtgggtacccncccgtgggtcctcgtcggtcctcctcgtacgtccctttaccaacccgtaacgggtccctacgtttcccccggg

SEQ ID NO: 363496 - DNA, 583 bp, Homo sapiens
  misc_feature: GZ8MTXP02GRHLT.44.86.H09.1.454.CMB.2.raw
  modified_base (458)..(458): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgtatcattcgttgggctggatccggcacgcccccgagggagggaagtggagtggagttggtgacatccattatacgtggggcacgtactactctccgtcccctcgaagagtcgtctcactgtttcgagggacacgtccatcgaaccgtcttctccctagaaactcgaaccctccgtcgacccgccgcgaccacggtccgtttattctgtgcgnggcgagtactggttcttacaatcgtacgtcggggtccgtcggcctacccgtgggtcctacgtcggttcctcctcgtaacgtccctttacccgaaccgtaaccggtccccgtaacgtttcccccgg

SEQ ID NO: 363497 - DNA, 589 bp, Homo sapiens
  misc_feature: GZ8MTXP02I8WNT.44.86.H09.1.454.CMB.2.raw
  modified_base (449)..(449): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggactccggcacgcccccgagggacgggaagtggaggtggagttggtgacatccattagtacgtggggcgacgtactacctcctcccgtcccctcaagtatccgtctccacctgtttcgacgggaccacgtccatcgaaccgtcttcctccctagaaactcgaccctcggtccgaccgccgcggaccncggtacctttattccgtgtcgcgtaggccgagtacgtggttacttcaattcgtagtcggggccgttggcctacccgttgggtacctcgtcgtcctcctcgcgtaccttacccgaccgaacgggtccctacgtttccccgg

SEQ ID NO: 363498 - DNA, 658 bp, Homo sapiens
  misc_feature: GZ8MTXP02H6QUQ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgattcattcgttggggctggatccggcacgcccccgaggggacggggaatgggagtggagttggtgacatcattatacgtggggcagtactactcctccgtccccctcaagtacgtcgtctcaccctatttccggaaggacctaccgtacctacgtacgaaacccgtcctttcccaccctacgtaaaccttcgaccccttccggtaccgaaccccgtcccggacccggtaccgtaccggtacccgtttttatttccgtaggttcgacggacgggcgtaagtccgtcggtttcctttacgtaaacgttcgttaacggtcgggggtccgtcgggtccctacccgttgggtcctacgttcgtccttccctcgacgtcccttaccgaacccgacgggcccctacgttcccccgg

SEQ ID NO: 363499 - DNA, 575 bp, Homo sapiens
  misc_feature: GZ8MTXP02JT12K.44.86.H09.1.454.CMB.2.raw
  modified_base (376)..(376): a, c, t, g, unknown or other
  modified_base (417)..(417): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatcattcgttggggctggatccggcgacgcccccgaggggacggggaagtggaggtggagttcggtgacatccaattatacgtggggcgacgtactactcctccgtcccctcagtacgtcgtctcactnttcgacgggacacgtccatcgaaccgcttctccctagaacncgtacctcgtcgaccgccgcgactacggtcgtttacttcgtgtcgtcggaggcgagacgttcggttactttcattctaggtcggggtaccgtggccacccggttgtcgtacgtcgtcctcctcacgtcctccgtaccgaccggtccgacgttccccgg

SEQ ID NO: 363500 - DNA, 622 bp, Homo sapiens
  misc_feature: GZ8MTXP02JZPKR.44.86.H09.1.454.CMB.2.raw
  modified_base (389)..(389): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggatttccatcagttctgatctattcgttggggctggatccggcacgccccgagggaggggagtggagtggagtggtgacatccattagtacgtggggcgacgtactactctccgtcccctcaagtgtcgtctcactcttcgaggacacgtcatacgaaccncttcctcctacgaaactcgtacccgtccgacgacccgccgacggaccgtaccggtccgttttaattcgtcggtcgacggacgggtaccgagaccgttcggttcctttacgtaaagttccgtaaggtcggggtcccggtcggcccgtacccgttcggtactaccgtccgttcctacccgtccgtaaccgtcccgttaccccaaccggtaccggggtccccacgtttcccccggg

SEQ ID NO: 363501 - DNA, 590 bp, Homo sapiens
  misc_feature: GZ8MTXP02IO1WC.44.86.H09.1.454.CMB.2.raw
  modified_base (232)..(232): a, c, t, g, unknown or other
  modified_base (435)..(435): a, c, t, g, unknown or other
  modified_base (444)..(444): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgcctcagtgtcgtggggccccagggcaggaggtcagcatctcctgcagttgggagcggctccaagnggcggggctaggttttgattgttcaatggtaccagcaacttccaggaacacgaccccaaatcgctctaatttaccgactaaccacctagttccggccctacgacggggtcccctagaccgtattccgtctcggcctccaagttcctcgggccacctcgaccgtcccctccgtggcccagtcaccgtggcctcgagctagaagngtggaggtntaatttacttacgtcgtcctacgttacctatcgaacgagacgacgtccttacgaggttcgggttgggttcggttcgggacggtacgggaccacgtcgttcgaccggttcgtacgggtacaccggaccgacggtcctccgtcccccg

SEQ ID NO: 363502 - DNA, 596 bp, Homo sapiens
  misc_feature: GZ8MTXP02I1EZ0.44.86.H09.1.454.CMB.2.raw
  modified_base (459)..(459): a, c, t, g, unknown or other
  modified_base (506)..(506): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttggggctggatccggcacgccccgagggaggggaagtggagtggagttggtgacatccattagtacgtggggcgtacgtactacctccgtccgtccccctacaacgtagtcgtctcctacctgtttcggacgggactaccgtccatcgaacccgtccttcctaccctagaaactcgaccctccgtcggaccgccgacggaccnccggtccgtttatttcctggttgcggaggtcgaagtcgttgttcttnaacttcgtagtcggggcgtcggcctaccgtggtcctacgtcgttcctcctcgacgtcctacccgaccggtaccggccctacggtttcccg

SEQ ID NO: 363503 - DNA, 567 bp, Homo sapiens
  misc_feature: GZ8MTXP02FS4M9.44.86.H09.1.454.CMB.2.raw
  modified_base (369)..(369): a, c, t, g, unknown or other
tcagacagtatatacacgaccggtgctcgatttagtgctatagacttggggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttggggctggatccggcacgccccgagggaggggaatggagtggattggtgacatcattatacgtggggcgacgtactactctccgtccccctcaacgagtcgtctccacctntttcgacgggacaccgtccagtcgaaccgtcttctccctagaaacctgaaccctccgtcgacccgccgcggaccacggtccgtttatttctgtgcgacggcgacgactggtctttacaatcgtagtcggggccgtggccacccgtggtcactcgtctcctcacgtccttaccgaccgaaccggccctacgttccccgg

SEQ ID NO: 363504 - DNA, 682 bp, Homo sapiens
  misc_feature: GZ8MTXP02JMY01.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtcttcgtggtacgtttccattctagttctgtatctattcgttgggctggacgtccggcgacggccccggaggggacggggaagtggaggtggagttggtgactactcctaagttacgtacggtggggtaccgtaacggttacctaccttccgtcccgttaccccctacgaacgtacgtccgttctaccactcgttacggacggaacctcgtaccacgtacgaacccgtcttcctacccgtacgtaaactcgacccgtccgtaccgacccgtcccgacggaccgtaccggttaccgttttacgtttccgtggtcgcgggacgggacgtacgtaccgttggttacttactagttacgtggtcggggtccggtcggtcctacccggttcggtacctcgtccggtttcccaccgttcgaccgttcctacccgaacccggtaaccggtcccctacgtttcccccgg

SEQ ID NO: 363505 - DNA, 671 bp, Homo sapiens
  misc_feature: GZ8MTXP02IOCEX.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtatttccatctagttctgatctattcgttggggctggatccggcacgccccgaggggacgggaatggagtggagttggtgacatacattactacgtggggactacgtactactactccgtcccctacgacgtacgtcgtctcacctgtttcgaggtacacgtccatcgaaccgtcttacctccctagaaaacctcgaacccgtcgtacggacccgcccggtaccgggaaccgtaccgggttacccgttttaacgtttcgtcgggttacggaccgggtagggtacccgacggtacgttcgggttactttacgaagtttcgtaggtcgggggtacccgtcggtaccctacccgttcgggtacctaccgttcggttcccttacccgtaacgtaaccggtcctttaccccgaaaccggtaccggggtacccctaacgtttcccccggg

SEQ ID NO: 363506 - DNA, 576 bp, Homo sapiens
  misc_feature: GZ8MTXP02IAGYS.44.86.H09.1.454.CMB.2.raw
  modified_base (369)..(369): a, c, t, g, unknown or other
  modified_base (467)..(467): a, c, t, g, unknown or other
  modified_base (540)..(540): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggaggggaatggagtggagttggtgacatccattatacgtggggcgacgtactactctccgtcccctacgaagacgtcgtctcacctntttcggaggactaccgtccagtcgaaccgtccttctccctgaaacctcgaacccttccgtacgacccgcccgtacgggaccacggtccgtttatttcnggttgcggtaggcgagacgtggttctttctaatctagtcggggccgtggcctaccgtggtcacgtcgtctccncgactccttaccaccgaacggccctacgttccccgg

SEQ ID NO: 363507 - DNA, 575 bp, Homo sapiens
  misc_feature: GZ8MTXP02FU7VR.44.86.H09.1.454.CMB.2.raw
  modified_base (369)..(369): a, c, t, g, unknown or other
  modified_base (441)..(441): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctggggctggatccggcacgcccccgagggaggggaatgggaggtggagttggtgacagtccattagtacgtggggcgtacgtactactcgtccgtcccctcaagtagtcgtctcaccntttccgagggaccacgtccatcgaacccgtcttaccgtccctagaactgaccctccgtcgaccgcgtcgacncgtcctttattcgtgtgcgaggcgagtaccgtggttcctttagaacttcgagttcgggccgttaggcctaccgtcgtcacttcggtcctcctcgaacggccttcccaacgtaacgggcccctaagtttccccgg

SEQ ID NO: 363508 - DNA, 620 bp, Homo sapiens
  misc_feature: GZ8MTXP02IAS54.44.86.H09.1.454.CMB.2.raw
  modified_base (386)..(386): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagttccatctagttctgatctattcttggggctggatccggcgacggcccccgaggggacggggaagtgggaggtggtagttgggtagacatcctaattatacgtggggacgacgtactacctctccgtcccctacgaacgtagtcgtctcacctntttaccggagggacctacgtaccagtacgtaacccgtccttcctaccctagtaaacctcgacccgttccgtacgacccgccgacgaccgtacggtccgttttattcgtgtcgcggaggcgagtacgtggttcttactaattcgtagtcggggtccgtcggcctaccgttcggtctacgtcgttcctacctcgtacgtccttaccgaccgtaaccggtaccctacgttcccccgg

SEQ ID NO: 363509 - DNA, 621 bp, Homo sapiens
  misc_feature: GZ8MTXP02IY78D.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttggggctggatccggcgacgcccccgaggggacgggaagtggagtggagttggtgacactctattagtacgtggggtacgtacgtacttacctctcccgtcccctacgacgtacgtccgtctaccacctgtttcgaacgggacctaccgtccagtacgaccctcgttcctcccgtacgaaactcgaaccctccgtccgaccgtccgcgaccgacggttcgtttacttccgtgtcgccggaggccgacgtacgtggttctttacgtaattccgtagggtcggggtccgtcggtaccctacccgtggtactcgttcgtcctccgtaacgcgtccttacccgacgaaccggtccctacgtttccccgg

SEQ ID NO: 363510 - DNA, 564 bp, Homo sapiens
  misc_feature: GZ8MTXP02JJ7CO.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggattggtgacatccattatacgtggggcgacgtactactctccgtcccctcaagacgtcgtctcacntttcgaggacacgtccatcgaaccgcttctccctagaaactcgaccctccgtcgaccgccgcggacacggtccgtttatttcgtgtcgcggaggcgagacgtggttcttcaatctagtcgggggccgtgggcctaccgtggtcctacgtcgttcctccgtcacgtccttacccgaccgtaacgggcccacgtttccccgg

SEQ ID NO: 363511 - DNA, 547 bp, Homo sapiens
  misc_feature: GZ8MTXP02JFP4P.44.86.H09.1.454.CMB.2.raw
  modified_base (427)..(427): a, c, t, g, unknown or other
  modified_base (463)..(463): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattctggggctggatccggcagccccgagggagggaatggagtggattggtgacatccaattataacgtggggcgacgtactactctccgtcccctacaagacgtcgtctcacctgtttcgagggacacgtcatcgaaccgtcttctccctagaaactcgacctcgcgaccgccgcgacncggtccgtttattcgtgtgcgaggcgagactcggtnttcaatcgtagtcggggcgtcggctacccgtggtacctcgtcgtctcctcacgtccttaccgacgaacgggcccagttccccgg

SEQ ID NO: 363512 - DNA, 599 bp, Homo sapiens
  misc_feature: GZ8MTXP02G214E.44.86.H09.1.454.CMB.2.raw
  modified_base (483)..(483): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggccgtgggacggtccctgagactcctcctgtgtagcgtctggattccaccttcaacagacagtggcatgcctacgtcggggtcccaccgagggcctccgaagggccgaaaaggggcgtgggaggtggggcgacctagttatagtggtatgaagtagggaaattaaataattattagtagtacgtagtttccggagaaacggggtcctaattccaacctatccgtaccaagacgaactaaagttacgaaaanaaccaaactacttaaatattacgtaaggtaaaatgaaatcgactaggaagacgtacgagacgtacggctgtactacgtactgcgacgaggaagagtgggactaggagtactacaag

SEQ ID NO: 363513 - DNA, 526 bp, Homo sapiens
  misc_feature: GZ8MTXP02IW1EK.44.86.H09.1.454.CMB.2.raw
  modified_base (280)..(280): a, c, t, g, unknown or other
  modified_base (303)..(303): a, c, t, g, unknown or other
  modified_base (381)..(381): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtggagtcgtgggggagcgtggtccagcctgggagtccctgagctctcctgtgtagcgtctggattcaccttcaacngacatggcatgcacgtgggtccnccaggcctccgaggcaaggggactggggagtgggtggcattatatggtatgatggaaagttaaatatattatgtagtnttcggtagaagggccgtattcacatctccagacgacaattacgaagaacacaactatatctaggaaatagaatagctgaagagacgacggacacggctagtctactacgtgtacgcgagaagagtggggactcggtggactacag

SEQ ID NO: 363514 - DNA, 626 bp, Homo sapiens
  misc_feature: GZ8MTXP02IX1RQ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttgggctggatccggcacgccccgagggacgggaatggagtggagttggtgaactactacctattaacgtacgtggggacgtacgttactaccgtccttcccgtccccctacaacgtacgttccgtctaccactgtttcgaggaccaccgtcagtcgtaaccctcttacctacctacgaaactcgacccgtcgtccgaccgccgacgacacgttaccgtttattcgtgtgcgtaggcgagtaccgtggttcttacaagttcgtaagggtcggggtccgtcggtacccgtaacccgttcggtacctacgtcggtcccttccgtccgtaacgtcccttacccgaaccgtaccgggtccctacgtttcccccgg

SEQ ID NO: 363515 - DNA, 585 bp, Homo sapiens
  misc_feature: GZ8MTXP02IH59S.44.86.H09.1.454.CMB.2.raw
  modified_base (349)..(349): a, c, t, g, unknown or other
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatctagttctgatcattcttggggctggatccggcagcccccgagggaggggaatggagtggattggtgacatccattatacgtggggcacgtactactctccgtcccctcaagngtctctcaccntttcgagggaccacgtccatacgaacccgtcttcctccctagaaaactcgaaccctccgtcgacccgcccggcggacacggtccgtttactttctgtgcgaggcgagactggtctttcaatctagtcggggtccgtggccaccgtggtacctaccgtcggttcctcccgtaacgtacggtccctttacccgaacccgaacggggtcccctaacgtttcccccggg

SEQ ID NO: 363516 - DNA, 565 bp, Homo sapiens
  misc_feature: GZ8MTXP02JA4OW.44.86.H09.1.454.CMB.2.raw
  modified_base (437)..(437): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgatctattcgttggggctggactccggcacgccccgagggagggaatggagtggagttggtgacatcattatacgtgggacgacgtactactctccgtcccctacaagtacgtcgtctacacctgttcgagggaccacgtccatcgaacctcttcctccctagaaactcgaccgtctcgccgcgcgacncggtctttattcgtgtgcgtggacgagacttggtcttacaagttctaaggtcggggccgttcggcctacccggtggtcctacgttcgtcctccgtcacgtcctacaccgtaacgggcctacgtcccgg

SEQ ID NO: 363517 - DNA, 602 bp, Homo sapiens
  misc_feature: GZ8MTXP02GP6GM.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagtttccatctagttctgatcattcgttggggctggacgtccggcgacgccccgaggggagggagtggaggtggtagttggtgactatcctattagtacgtggggcgtacgtactactccttccgtccccctacgaagtacgtccgtctaccacctgtttacggacgggactaccgtccagtacgaccgtcttcctaccctagaaactcgacctccgtcgacccgtccgacggaccgtccggtcgtttacttcgtgtagcggaggcgagtcgttgttctttcagtcgtaggtcggggtcgtcggaccgtacccgttggcctacgttcgtcctcctcgacgtccttacccgaacgaccggtccctacttccccgg

SEQ ID NO: 363518 - DNA, 660 bp, Homo sapiens
  misc_feature: GZ8MTXP02F5DVF.44.86.H09.1.454.CMB.2.raw
  modified_base (311)..(311): a, c, t, g, unknown or other
  modified_base (385)..(385): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcacccttcaaacagaccatggacatgcacgtgggtcccnccaggcctccgaggcaaggggactgggaggtgggtgctacgttagagtggtatggattagggaaattaataatnttaatggtagtacttcggtaggaagggacccgtattaccgacctagtcctaccgtaagaacgtaacctaaagttaccgaaaagaaaccaaactaaaccttaaattaacgttcgtaagggtaaaagtagtaaaatacgggacccttaggaaaggacggacccgggaaggaacccgaccgggtacgttaggttaccttaaaccgtacgttacggtaggaccgtaaggaaggtaacggtcggggggtacccttacgggtaggaaccttaacggaaagg

SEQ ID NO: 363519 - DNA, 712 bp, Homo sapiens
  misc_feature: GZ8MTXP02FST3Y.44.86.H09.1.454.CMB.2.raw
  modified_base (280)..(280): a, c, t, g, unknown or other
  modified_base (301)..(301): a, c, t, g, unknown or other
  modified_base (329)..(329): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcagcatctcctgcactggaaccaacagtgacgtcggtcgttttgaccgtgtctcctggtaccagcacggaccccagaaacncgacccccaaatcattatttngtcgtacaatcgttccgcccttccggtntacccctgacgtccgtctttccgtccgtacggggtaccaagttcgtacggacctaaccgcccgggtccccttacccgtcgtaaccctagttcccgtcgtcggggcccttacccggagggccgttggaacggggtacgacggtccttaggtactttaacgtctacgacgtacgtctactattaaacgtaacgtaaacggttacggtaaaccttactttttaaaccgtacgtttaccggggacctacggggtaaacggaacccgttaaacggccgttaaccgggtaacccggttaccgttaaacggggccctaaaaccgggccccgtaaaacgggtcccgttaccccggtccccctttaacggggtcccctaccgtttcccccgg

SEQ ID NO: 363520 - DNA, 820 bp, Homo sapiens
  misc_feature: GZ8MTXP02JRLR8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgctactgtctctggtactttccatctagttctgtatctattcgttggggctggattcggcacgcccccgaggggacgggaaagtggaaggtggtagttggtgacgtactcctattagtacgtggggcgtacgtactactcctccgtccccctcgaagtacgtccgtctacctacctacgtttacggacggggtacctacgtacccgaacgtaccggaaacccgttccgtttacccgttacccccgttacggtaaaaacccgttcccggtaaacccccgttttcccggtacccggtaaccccgggcccccggtacccgggggtaaaccccgttaacccggggtttaccccggtttttaacgttttaccccggtagggtttccgggaccgggttacggggaccggtaacgggttaacccgttcgggggtttaccttttacggaaactttccggtttaacgggtcgggggtacccgtttcggggaccccgttaaccccggttcggggttaccctaccgttaccggttccccttaccccggtcctaaccgttccccgttacccgtaaaccccggaacccggggtacccctaacggttttccccccggg

SEQ ID NO: 363521 - DNA, 737 bp, Homo sapiens
  misc_feature: GZ8MTXP02I8PGL.44.86.H09.1.454.CMB.2.raw
  modified_base (311)..(311): a, c, t, g, unknown or other
  modified_base (349)..(349): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcgtggtccagccgtgggacgtccctgagactctcctgtgtagcgtctggattcaccttcaacagacatggcatgccagtcgggtccnccgaggcctccgaggcgaaagggcgtgggaggttgggnggctaacgttatagtggtatgaagttagggaaaagttaaattaattatttaagtacggttagtacgtttacccgggtagggtaaacggggtaccctaagtttacccaacccgttaacttacccgttaacccgaaaggtaaccggtaaacctaaacgtttaacccggaaaacgtaaacccaaaccgtaaacctttaataacgtttacgtaaagggtaaaattacggtaaacgttacggtaccctagggaaacggacggacccggaaaggggaacccgaaccgggtcgttacggttacccgttaaacgttaccgttagggtacgaaccggtaaggaaggggtaacgggtcgggggtacctttaccggggaggtaacgtttaacggaaagg

SEQ ID NO: 363522 - DNA, 570 bp, Homo sapiens
  misc_feature: GZ8MTXP02JELDA.44.86.H09.1.454.CMB.2.raw
  modified_base (389)..(389): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccaggaggggactggagtggattggtgacatccattatacgtggggcgacgtactactctaccgtccccctcaagacgtcgtctcaccatttcgaagggacacgtccatcgaaccncttctccctagaactgaccctcgtgacacgcgacgacgtaccgtctttagtcgttgtcgcgggagacgagtcgttcggtttcttaacgtactacgtcgggtccgggtcggtcgtacccgtaccgttcggtactcgtcgtacctccacgtcgttccaccgtaaccggccggtaccttcccgg

SEQ ID NO: 363523 - DNA, 767 bp, Homo sapiens
  misc_feature: GZ8MTXP02IYU4P.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccaggactggtgacggccttcgggaacctgtctctcatctgcactgtctctggtagtttccattctattctgatctattcgttgggctggactccggcacgccccgagggagggagtggagtggagttggtagactactcctaagttacgttacggtcggggacgtaaccggttaacttaaccgttccgtccccgttaccccccgtaacgtaaacggtacgttcccggttccttacccgtaaccttacgttttaccgggaaacggggtaaccgtacccgtaacctacgtaaccgtaaacccgtcctttacccgttaacccgtaacgtaaaccgtccgtaacccgttaccggtaccgaccccggaccggaccggtacccgtacggttacccgttttaatttccggtacggttggacggtacgggtacgtacggtacgtttacgggtttacctttaacgtaaacgttcggttaacgggtccggggtaccgggtcgtacccgtaccggttcggtacctacgttccgttcccgttaccgtaaccgtccgtacccgttacccgaaaccggtaacccggtccgtaccgttttcccccgg

SEQ ID NO: 363524 - DNA, 597 bp, Homo sapiens
  misc_feature: GZ8MTXP02GTRC9.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggaggggaagtggagtggagttggtgacatccattagtacgtggggacgacgtactactcctccgtccccctcaagtagtcgtctcacctgtttcgagggaccacgtccagtcgaaccgtcttacctccctagaaactcgaaccctccgtcgacccgccgtccggacacggtcctttattcgtgtgcgagggcgagtacgtggttcttacgaatcgtagtcggggtccgtcgggctacccgtggtacctacgtcgtcctcccgtcgtaccgtcctttacccgaaccgtaaccgggcccctaacgtttcccccgg

SEQ ID NO: 363525 - DNA, 597 bp, Homo sapiens
  misc_feature: GZ8MTXP02JY9UQ.44.86.H09.1.454.CMB.2.raw
  modified_base (561)..(561): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtactttccatctagttctgtatctattcgttggggctggacgtccggcacggcccccgaggggacggggaatggaggtggagttggtgacatcctattatacgtggggcgacgtactactccgtcctcccctacaagtacgtccgtctccacctatttcggaggacctacgtccagtacgaaccgtccttcctaccctagaaacctcgaccctccgtcgacccgccgcggacacggttccgtttattcgtggtcgcggacggacgagtacgttcggttactttcaattcgtagtcgggggtccgtggcctacccgtgtctactcgtcctccncgtacgtccttaccaccgacggcccacgttccccgg

SEQ ID NO: 363526 - DNA, 581 bp, Homo sapiens
  misc_feature: GZ8MTXP02F0O7S.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgtggggctggatccggcacgcccccgagggacggggaatgggagtggagttggtgacatcctagttatacgtggggcgtaacgtactactctccgtcccctcaagacgtcgtctcactgtttcgaggtacacgtccatcgaaccgtcttacctccctagaaactcgaaccctcgtcgaacccgccgtacggacacggtcctttattctcggttgcgaggcgacgtacgtcggttctttacaagttctaggtcggggtccgtggcctaccgtggtacacgttcgtcctctcgacgtccttacccaccgtaacggccctacgtttccccgg

SEQ ID NO: 363527 - DNA, 634 bp, Homo sapiens
  misc_feature: GZ8MTXP02GXPRU.44.86.H09.1.454.CMB.2.raw
  modified_base (308)..(308): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtatctattcgtggggctggactccggcacgccccgagggagggagtggagtggagttggngacatcctagttacgtacgtggggacgtacgtactacctccgtccgtcccctacgagtacgtcgtctcactgttcgaggtacacgtcatacgaccgtctacctcctacgaaactcgaccctccgtaccgacccgtccggacggaccgtaccgggttaccgttttacgttcgtcggttacggcggtacgggacgtacgtacgttggttacctttacgtaacgttcgtagggtccggggtccggtcggaccttacccggtcggtcctacgtcgttccctccgtcgtacgtcccttacccgaccgaccgggtccctacggtttccccgg

SEQ ID NO: 363528 - DNA, 592 bp, Homo sapiens
  misc_feature: GZ8MTXP02I2MLN.44.86.H09.1.454.CMB.2.raw
  modified_base (354)..(354): a, c, t, g, unknown or other
  modified_base (370)..(370): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggcccaggactggtgaggccttcgggaacctgtctctcatctgcactgtctctggtacgtttccatctagttctgatctattcgttggggctggatccggcacgcccccgaggggacggggaatggaggtggagttggtgactatcattatacgtggggctacgtactctctccgtcccctanagactcgtctacactnttcgaggtacacgtccagtacgaacgtctctacctagaactcgacctccgtcgaccgcgcgacgacgtcgtttattccgagtcgtcggacggacgacggtacttgggttctttacgaacttcgtaacgggtcggggtaccgtcggtcctaccggtggtcgtaccgtcgtcctcgtcgtaacgtccttacccgaaccgtacgggtaccctagtttcccccggg

SEQ ID NO: 363529 - DNA, 633 bp, Homo sapiens
  misc_feature: GZ8MTXP02FOUU6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgtactctattcgttgggctggactccggcacggccccgaggggaggggaatggaggtggagttgggtagacatcctattagtacgtggggcgtaacgtactactcctccgtcccctacagtatcgtctcacctagttcgacggtacaccgtccatcgaacccgtcttcctacccgtagaaacctcgaacccgtccgtcgacccgccggacggaccgtaccggttaccgttttagttccgtcggtgaccgggtaggcggacgtacgttcggttactttacgaagtccgtgggtcgggggccgttcggaccctcccgtgggtacctaccggttctacctccctgaccggttcctacccgaaccggtacggcccctacgttcccccggg

SEQ ID NO: 363530 - DNA, 628 bp, Homo sapiens
  misc_feature: GZ8MTXP02GEXXM.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttgggctggactccggcgacgcccccgaggggacgggagtggaggtggtagttggtgactatcctattagtacgtggggcgtacgtactactccttccgtcccctacaacgtcgtcgtctacacctgtttcggaacgggtacctacgtccagtacgtaacccgtccgttctaccctagaaacctcgaccctccgtacgacccgccgacggtacgtaccggtccgtttattcgtgtcgcgaaggcgaacgtcgttggttctttacgaattcgtacggtcggggtccggtcgtacgtacccgtcgggttctaccgttcgttccctacctccgacgtcccttacccgaacccgtaacggtcccctacgtttcccccgg

SEQ ID NO: 363531 - DNA, 592 bp, Homo sapiens
  misc_feature: GZ8MTXP02ITZZI.44.86.H09.1.454.CMB.2.raw
  modified_base (451)..(451): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgtgggctggatccggcacgcccccgagggacgggaatggagtggagttggtgacatccattagtacgtggggacgtacgtactactctccgtcccctacaagacgtcgtctcactgttcgagggtaccacgtccagtcgaacccgtcttcctccctagaactcgaccctcgtcgaccgcgcgacgcgtacttattcngtgcgtacggcgacgtacgtggttactttacgaacgttcgtacggtcggggtccgttcggaccctacccgttcgggtacctccgttcgtcctcctcgtacgtcccttaccgaacccgtaacgggccctacgtttcccccgg

SEQ ID NO: 363532 - DNA, 597 bp, Homo sapiens
  misc_feature: GZ8MTXP02IOQ4A.44.86.H09.1.454.CMB.2.raw
  modified_base (406)..(406): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagttccatctagttctgatctattcgttggggctggactccggcacggccccgaggggacggggaatggaggtggagttggtagacatcagttatacgtggggactacgtactactctccgtcccctacgaagacgtctctcactgttcgaggtacacgtccatcgtaaccgcttcnccctagaaactcgaccctcgtcgaccgcgcgacgtaccggtcgtttattcgtgtcgcggtaggacgtagtacttcgggtctttacgaactcgtagtcgggggtccgtcggccgtaccccgttgggacctacgtccgttcctcctcgtacgtcccttacccgaaccgtaaccgggcccttaacgttccccgg

SEQ ID NO: 363533 - DNA, 581 bp, Homo sapiens
  misc_feature: GZ8MTXP02IPJUG.44.86.H09.1.454.CMB.2.raw
  modified_base (307)..(307): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggagggaagtggagtggagttggngacatccattatacgtggggcgacgtactactctccgtcccctcaagcgtcgtctccgacctgtttcggaacgggtaccaccgtaccatcgaacccgtcttccaccctagaaactcgaaccctccgtcgaccgccgcgacacggtcctttattctgtgcgaggcgagaccgttggttcttacaatcgtagtcggggtcctcggtcctaccgtcggtcctacgtcgtcctccgtcgacgtccttaccgaaccgaacgggtccctacgttccccgg

SEQ ID NO: 363534 - DNA, 573 bp, Homo sapiens
  misc_feature: GZ8MTXP02GDL5D.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggaggggaatggagtggagttggtgacatccattatacgtggggcgacgtactactctccgtccccctcaagagtacgtctcacctntttcgaggtacacgtccatcgaacctcttctccctagaaactcgaccctccgtcgacccgcccggcggaccgacggtaccgtttattcctgtgtcgagggcgacgacgtcggtctttcaattcgtagtcggggccgtggccacccgtggtccacgttcgtcctcctcgacgtccttacccgaccgaacgggccctacgtttccccgg

SEQ ID NO: 363535 - DNA, 540 bp, Homo sapiens
  misc_feature: GZ8MTXP02FK7G5.44.86.H09.1.454.CMB.2.raw
  modified_base (365)..(365): a, c, t, g, unknown or other
  modified_base (428)..(428): a, c, t, g, unknown or other
  modified_base (465)..(465): a, c, t, g, unknown or other
  modified_base (506)..(506): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcagcccccgagggaggggaatggagtggagttggtgacatccattatacgtggggcgacgtactactctccgtccccctcaagacgtcgtctcacctntttcgagggacacgtcatcgaaccgcttctccctagaaactgacctccgtcgaccgcgcgacncggtcctttattctgtgcgaggcgagactggtctttnaatctagtcggggcctggccaccgtggtcacgtcgtctccncgacgtccttccaccgtaacggcccagttcccgg

SEQ ID NO: 363536 - DNA, 648 bp, Homo sapiens
  misc_feature: GZ8MTXP02FFZ5J.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcagcccccgagggacgggaatggaggtggagttggtgactatcctaattatacgtggggcgacgtactactctccgtcccctcaacgacgtcgtctcacctacttcggaggtacacgtccagtacgaaacccgtcttccgtaccctagaaaaccttcgaaccctccgtcgaacccgcccggccgggaccgtaacggttcccgtttaagtttccgtcggttcgacggacgggccgtaacggtccttggggttccttttacgattaccgtaggtcgggggtccgttcggccgtaacccgtcgggttcctaacgttcggtccttcccgtaacgtacggtcctttacccgaacccgtaacggggacccctaagtttcccccggg

SEQ ID NO: 363537 - DNA, 644 bp, Homo sapiens
  misc_feature: GZ8MTXP02HA1AD.44.86.H09.1.454.CMB.2.raw
  modified_base (613)..(613): a, c, t, g, unknown or other
tcagacagtatatacacgaccggtgctcgatttagtgctatagacttgggtttggggatgctttctgagagtcgaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattcgttggggctggatccggcacggcccccgaggggacgggaagtggagtggagttggtgacatcctattactacgtggggacgtacgtactacctcctccgtcccccctacgaagtacgtcgtctccacctgtttcgacggggtacacgtccatacgaacccgtcttccgtccctagtaaacctcggaaccctcccggtacgaacccggcccggaccgggaacctaccgggtacccttaatttttaacgtttcgtgttcggccgggtaagggccgtaagtaccgttgggtcttttacgaattccgtaggtcgggggtaccgttgggcctacccggtggtaccacgttcgttcctccgtaccnccgtcctaccgaaccggtaccggtccctacg

SEQ ID NO: 363538 - DNA, 667 bp, Homo sapiens
  misc_feature: GZ8MTXP02GM22S.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgctactgtctctggtagtttccatcagttctgatctattcgttggggctggatccggcacgcccccgaggggacgggaatggaggtggagttggtagactatccattatacgtggggcacgtactactccgtccgtcccctacgaagtgtccgtctccactcgtttcgaggtactacgtccagtacgaaacccgtcttcctacccgtagaaaacctcgtaacccgttcccgtacgaccccgaccgggccgaacgacccgggttccttttaacgtttccgtcgttacggcgacgggcgtaacgtacgttcggttactttacgacttcgtaagtcggggcccggtttcggacccgtaacccggttcggtaccgtccgttccggttaccgttccctaacggtacgtccctttacccgaaacccggtaaacccggggcccctaacgtttcccccggg

SEQ ID NO: 363539 - DNA, 626 bp, Homo sapiens
  misc_feature: GZ8MTXP02IOJMU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggcccccgaaggggaggggaagtggaggtggagttggtgacatcctattagtacgtggggcgtacgtactactcctccgtcccctacgaagtacgtccgtctaccacctagtttcggacgggtaccaccgtccaagtcgaacccgtcttcctccctagaaactcgtaccctccgtcgacccgtccggccgaccgtaccggtccgtttattctggtcgcggtaggccgacgtacgttcggttctttacgaagttcgtaggtcgggggtcccgttgggccctacccggttggtacctacgttcgtccttcctcgacgtcccttaccgacccgaacggtcccacgtttccccgg

SEQ ID NO: 363540 - DNA, 629 bp, Homo sapiens
  misc_feature: GZ8MTXP02JD8RR.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatcagttctgatcattcgttggggctggatccggcacgcccccgaggggacgggaagtggaaggtggagttgggtgacgatccgattagtacgtggggcgtacgtactactctccgtcccctcaagacgtcgtctaccacctgtttcggaagggtaccacggtccagtacgaaccgtcttcctcccgtagaaactcgaaccctccgtacgacccggccgtacggacctacggtccgtttacgtttctcggttcgacgtacgggtcgtaacgtaccggttggttactttacgaagttcgtagtcgggggtccgttgggcctaacccgtggtcctacgtcgtcctccgtaacacgtaccttcccgaaccgtaacgggtccctacgtttccccgg

SEQ ID NO: 363541 - DNA, 652 bp, Homo sapiens
  misc_feature: GZ8MTXP02F5QAK.44.86.H09.1.454.CMB.2.raw
  modified_base (282)..(282): a, c, t, g, unknown or other
  modified_base (286)..(286): a, c, t, g, unknown or other
  modified_base (310)..(310): a, c, t, g, unknown or other
  modified_base (365)..(365): a, c, t, g, unknown or other
  modified_base (391)..(391): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctctttaagaggtgtccagtgtcaggtgaagctggtggagtcgtgggggaggcgtggtccagccgtgggacggtccctggagactctcctgtgtagcgtctggattcaccttnaacngacagtggcatgcacgtgggtccncgaggcctccgaggcaaggggctgggaggtggggtgctaacgtttatagtggtangtagtagggaaaacgttaataagttntttaacgtaggttaagtacgtttacccggggtaggaaaaccgggggtccctaatttacccgaacctaacgttccctacccgaaaggaccgaaactaaacgttacgaaaacgaacctaaactaaaccttaataacgttactaaggggaaaatggtaaaactagcctaagggaacgacgaccggaaggaaccacgggtactaggtactaacgtactcgtggacgtaaggaagtggtacggggctacggtaggaactaagaagg

SEQ ID NO: 363542 - DNA, 649 bp, Homo sapiens
  misc_feature: GZ8MTXP02I9S4O.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgaggggacggggaagtggaggtggagttggtgacatccattatacgtggggcgacgtactactctccgtccccctcaagtactcgtctcacctgttcgaggaccaccgtcagtcgaacccgtcttcctccctagaaactcgtaacccgtcgtcgacccgccgccggactaccggtccgtttatttcgtacgttcgaccgagggaccgaaggtccgttggttcttttaccaagtttaccgtaggttccgggggtccgttacgggccctaaacccggttcgggtacctaccgttcggtttcctaccccttaacgaaccggttccctttaccccggaacccgtaaaccgggggtccccctaacgtttcccccggg

SEQ ID NO: 363543 - DNA, 550 bp, Homo sapiens
  misc_feature: GZ8MTXP02FZYMN.44.86.H09.1.454.CMB.2.raw
  modified_base (353)..(353): a, c, t, g, unknown or other
  modified_base (364)..(364): a, c, t, g, unknown or other
  modified_base (425)..(425): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggacggggaatggagtggagttggtgacatccattagtacgtggggcgacgtactactctcgtcccctcaagntcgtctcactnttcgagggacacgtcatgaaccgtctctccctagaaactgacctcgcgtaccgcgtcgacncggtcctttattctgtcgtcgaggcgagtcgtcggtctttcgaagtctagtcggggccgtgcgtaacccgtggtcacgtcgtctccgtcgacgtcttaccgacgtaaacggccctaagttcccgg

SEQ ID NO: 363544 - DNA, 616 bp, Homo sapiens
  misc_feature: GZ8MTXP02JIUZG.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgtgggctggatccggcacgccccgaggggagggagtggaggtggagttggtgactatcctaattagtacgtggggacgtacgtacctactcctcccgtcccctacgtaacgtacgtccgtctccacctcgtttcgagggtaccacgtccacgtcgaaaccgtccgttcctaccctagaaacctcgtacccgtcgtcgaccgccgacggaccgtacggtacctttattcgtagtcgcgagggaccgtagtcgttaggttctttcgaactcgtacgtcggggtaccgtcggacctcccgtcggtactccgtcggttcctccttaacgacggtcccttacgaccgtaacggccctagttccccgg

SEQ ID NO: 363545 - DNA, 544 bp, Homo sapiens
  misc_feature: GZ8MTXP02JZWG9.44.86.H09.1.454.CMB.2.raw
  modified_base (309)..(309): a, c, t, g, unknown or other
  modified_base (414)..(414): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggcctggggaggtccctgagactctcctgtgtagcgtctggattcaccttcaacagacatggcatgcacgtgggcccncaggctccgaggcgaagggctgggagtgggtgctagttatagtggtatgataggaaattaataatattatcgtagagttcgagacggcgtatcactatctcaganactaattacgaaagaacacactatactacgtagaaatagaactagactagacgacggaccgacggaacgacggactagtcctacgtactcgacgacgaggaagtagtggggtctaggtagacgtacgtag

SEQ ID NO: 363546 - DNA, 594 bp, Homo sapiens
  misc_feature: GZ8MTXP02FS8PB.44.86.H09.1.454.CMB.2.raw
  modified_base (457)..(457): a, c, t, g, unknown or other
  modified_base (543)..(543): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgcccccgaggggacggggaatggaggtggagttggtgacagtcctattatacgtggggcgtacgtactactccgtccgtcccctacaagtacgtcgtctccactgtttcgagggacacgtccagtcgaaaccgtcttcctccctagaaacctctaacccttccgacgacccgcccgcggaccncggtaccgtttagttcgtgttgcggtagggcgaacgtactggttctttacaattcgtagtcggggtccgtcggcctaccgtgtacncttcgtccttcctcgacgtccttaccgaccgtacggccctacgttccccgg

SEQ ID NO: 363547 - DNA, 616 bp, Homo sapiens
  misc_feature: GZ8MTXP02I8GAL.44.86.H09.1.454.CMB.2.raw
  modified_base (180)..(180): a, c, t, g, unknown or other
  modified_base (282)..(282): a, c, t, g, unknown or other
  modified_base (304)..(304): a, c, t, g, unknown or other
  modified_base (344)..(344): a, c, t, g, unknown or other
  modified_base (376)..(376): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagnggtgtccagtgtcaggtgaagctggtggagtcgtgggggagcgtggtccagcctgggagtccctgagactctcctgtgtagcgtctggattcaccttcaacngacatggcatgcacgtgggccncaggcctcgaggcaagggctgggagtgggtgctacgttanagtgggtatgaattggaaaagttaataagttnttagtcgtaagtacttcggtaggaacgggccgtattccacctaatcctaccgaagacgaactaagttaccggaaaacgaaccaactaacttaattacgttacgtaagggtaaattaagaaacgtacggaccgtaggaacggacggaccggaaggaccgtacggtcttaggtacctaacgtacgtacggtacggacgaaggaacggtaggtacggggtcttacggtacggtaactaacgag

SEQ ID NO: 363548 - DNA, 559 bp, Homo sapiens
  misc_feature: GZ8MTXP02FV4ZX.44.86.H09.1.454.CMB.2.raw
  modified_base (297)..(297): a, c, t, g, unknown or other
tcagacagtatatacacgaccggtgctcgatttagtgctatagacttgggtttggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcaccagtggtcattttccctatggctccaacagaagcctggccaacgccccagacactaattangatataactattagacagtcctggacacctcgcccgcttactcacgtcctcccctcgttacggggacaaacgcccgccctcgaccctttcgacgtcgcgcagccgtgacgatggaggctgactattactgcttgctctcctatagtggttatcgtattggtcggcggtaggaccgaagtcgtcgaaccgtcgtaggtccacgtacccgaacggtcctccgcccccgtcggtcctacgtcctccgtttccccacccttcctac

SEQ ID NO: 363549 - DNA, 720 bp, Homo sapiens
  misc_feature: GZ8MTXP02I97TD.44.86.H09.1.454.CMB.2.raw
  modified_base (226)..(226): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctntggtatttccatctagttctgtatctattcgttgggctggactccggcacgccccgaggggacgggaatggagtggagttggtgactatcctattacgtacgtggggctaacgtactacctccgtcccgtcccctacagtacgtcgtctccacctgtttcgacgggtacacgtccagtcgtaacccgtcttcctccctagtaaactcgaaccctccgtccgtacccggccggtacggaccgtaccggttaccgtttacgtttcgtcggttcgaccgggtacgggtaccgtaacggttaccgttcgggtttacctttaccgtaaagtttccgttaacgggttccgggggtacccggtttaccgggcccgttaaccccggtttggggtaaccccttaccggtttccggttcccttaacccgtcccgttaaccggttccccgtttaaccccggaacccggtaaacccggggtcccccttaacggttttccccccggg

SEQ ID NO: 363550 - DNA, 582 bp, Homo sapiens
  misc_feature: GZ8MTXP02GT8JY.44.86.H09.1.454.CMB.2.raw
  modified_base (445)..(445): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgcccccgaggggacggggaatgggagtggagttggtgactatccattatacgtggggcgtacgtactactcctccgtccccctcaagacgtcgtctcacctgtttcgaggtacaccgtccatcgaacccgtcttcctccctagaaactcgaccctcgtcgaccgccgcgacncggtcgttattctcgtgcgtacggcgagtacgtgttcttcgtatcgtagtcgggtccggtcggtccgtacccgtcggtcgtacgtcgttcctcctcgtacgtccgttacccaccgaaccggtccctacgtttcccgg

SEQ ID NO: 363551 - DNA, 642 bp, Homo sapiens
  misc_feature: GZ8MTXP02GHK7K.44.86.H09.1.454.CMB.2.raw
  modified_base (383)..(383): a, c, t, g, unknown or other
tcagacagtatatacacgaccggtgctcgatttagtgctatagacttgggtttggggatgctttctgagagtcaaggacctcctgtgcaagaacatgaagcacctgtggtttttccttcctgctggtggcagctcccagatgggtcctgtcccaggtgcagctgcaggagtcgggcccaggactggtggaggccttcgggaaccctgtctctcatctgcactgtctctggtagtttccatctagttctgatctattcgttgggctggactccggcacgccccgagggacggggaagtggaggtggagttggtgactatactattaagtacgtggggcgtacgtacctactcctccgtcccctacaagcgtcgtctaccacgtnttcgagggaccacgtccatcgaaccgtcttcctaccctagtaaaccgtctacccgtccgtcgacccggcccgtacggaccgtacgttccgtttaagtttcgtgtcgcgtacgggcgacggttacgttcgggttctttaacgacgtttcgtaagggtccgggggtccgttcggaccctacccggttcggttaccgtaccgtcgttccctcccgtaactacgtcccttacccgaccgaaccggtcccctagtttcccccgg

SEQ ID NO: 363552 - DNA, 743 bp, Homo sapiens
  misc_feature: GZ8MTXP02FOJ17.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatcagttctgtatctattcgttggggctggatccggcacgcccccgagggagggaagtggaggtggagttggtgactatacctattatacgtggggcgacgtactactcctccgtccccctacgaacgtacgtcgtctacctaacctagtttacgggaacgggtactaccgtaccagtacgaaaccgtcctttcctacccgtagtaaaaccgttcgaacccgttccggtaccggaaccccggcccggtaccgggaaccgtacccgggtttacccgttttaacgtttcgttcggttcggtaccgggtacggggaccggtaacggtaccgttcgggtttacctttaacgtaaacgttaccgttaaggggtcccgggggtaccggttccgggacccgttaaccccggttcgggtcccttaaccgttccggttcccttaccccggtcctaccggtacccctttacccggaaacccgtaaacccggggtcccctaacggtttcccccccggg

SEQ ID NO: 363553 - DNA, 621 bp, Homo sapiens
  misc_feature: GZ8MTXP02JDUY6.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgtatctattcgttgggctggactccggcacggcccccgaggggacgggagtggagtggagttggagactagtcctattactacgtggggacgtacgtactactcctccgtccccacgtaagtcgtcgtctacacctgttcgagggtaccaccgtccagtacgaacctccttcctaccctacgaactcgacctccgcgaccgtccgacgacacggttccgtttattctagtcgtcgaggcgtagacgttcgttacgttcaacgttcgtaggtcggggtaccgtcgggacctaccccggtagtaccgtaccgttcgtaccctcgttaaccgcggttaccttaccccgacggaaaccggtccccgtacgtttcccccgg

SEQ ID NO: 363554 - DNA, 582 bp, Homo sapiens
  misc_feature: GZ8MTXP02G6FSG.44.86.H09.1.454.CMB.2.raw
  modified_base (377)..(377): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatctattcttggggctggatccggcacgcccccgagggacgggatgggaggtggagttggtgacagtcctattagtacgtggggcgtacgtactactcgtccgtccccctcgaagtacgtcgtctacacngtttcgacggactacgtccatcgaaacccgtcttcctaccctagaaactcgaccctcgtacgcccgccggcggaccgacggtctttattcgtgtgcgaggcgagacgttggtcttcgaatcgtacgtcggggccgttggcctacccgtcggtctacgtcgtcctcctcgcgtccgttaccgaccgaacggtcccagtttccccgg

SEQ ID NO: 363555 - DNA, 588 bp, Homo sapiens
  misc_feature: GZ8MTXP02FYZRK.44.86.H09.1.454.CMB.2.raw
  modified_base (385)..(385): a, c, t, g, unknown or other
  modified_base (475)..(475): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggactccggcacggccccgaggggacgggaagtggagtggtagttgggtagactagtcctaattacgtacgtggggacgtacgtactactcctccgtcccctacaagtacgtcgtctccactnttcgaggacacgtcatcgaaccgtctacctccgtagaaactcgtaccctccggtcgacccgccgcgacgtacggtccgtttattcgtcgngcggaggtcagtcgttgttctttacattcgtagtcgggtacgtggacctaccgtgtcgtactcgtccttacctcgtaccgtcgttacccacgtaacggccctacgttccccgg

SEQ ID NO: 363556 - DNA, 513 bp, Homo sapiens
  misc_feature: GZ8MTXP02ICU7R.44.86.H09.1.454.CMB.2.raw
  modified_base (284)..(284): a, c, t, g, unknown or other
  modified_base (378)..(378): a, c, t, g, unknown or other
  modified_base (384)..(384): a, c, t, g, unknown or other
  modified_base (417)..(417): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctctttaagaggtgtccagtgtcaggtgaagctgggtggagtcgtgggggaggcgtggtccagcctgggaggtccctgagactctcctgtgtagcgtctggattcaccttcaacngacatggcatgcactgggtccgccaggcctccaggcaaggggctgggagtggggtgcacttatatggtatgatggaaagtaatatattatgtanattcgngaaggcgatcacatctccagagacaattagaanaacacactatatctaggaaatgaatagacctgagagccgaggacacggctggtactactactgtagcgagaagagtggggctcgtggaatacgaag

SEQ ID NO: 363557 - DNA, 737 bp, Homo sapiens
  misc_feature: GZ8MTXP02HLPU3.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgtgggctggactccggcacggccccgagggagggaatggagtggattggtgactatacctattagtacgtgggacgtacgtactactctccgtcccctacgaagtacgtcgtctaccgtacctcgtttacggaggtacctaccgtacctaacgtacgaaacccgtctttacccgtacccgtagtaaaacctcggtaacccgtcccggtacggaacccgcccggaccggtaccgtacccgggttacccgtttttaacgtttccgttacgggtttacggaccgggtaacggggtaccggtaacggttaccgtttcggggttacccttttaacgaaacgtttccgtaacggggtccgggggttcccggttacgggtaccccgtcccggttacgggtccctaaccgttcggttacccttacccgtccgtaacggtccctttaaccccgaaccggtaaacccggggccccttaacggtttcccccggg

SEQ ID NO: 363558 - DNA, 613 bp, Homo sapiens
  misc_feature: GZ8MTXP02JMK17.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaaccctgtctctcatctgcactgtctctggactttccatcagttctgatcattcgtggggctggatccggcacgcccccgagggtacggggaatggagtggagttggtgacatcctattatacgtggggactacgtactactctccgtcccctcgaagtacgtcgtctacacctgtttcggaacgggtacctaccgtccagtacgaacccgtccttccgtaccctagaaaacctcgaaccctccgtcgacccgtccggtggacctacggtccgttttagtttcgcgttgccgtagggcgagtacgtggttctttacgaattcgtaagtcggggtaccgtggcccgtaccgtggtacctacgttcgttcctccgtcgacggtcccttacgacccgtaacggccctacgtttccccgg

SEQ ID NO: 363559 - DNA, 712 bp, Homo sapiens
  misc_feature: GZ8MTXP02GXNER.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgcactgtctcgtggtacgtttccatctagttctgtatctattcgtgggctggatccggcacgccccgagggacgggagtggaggtggagttggtgacagtcctaattagtacgtggggcgtacgtacgtacctcctccgtccccctagaacgtacgtccgtctaccacctgttccggaggacctaccgtcagtacgacccgtcttcctcccgtaagaacccgtgacccgtccggtccgacccggccgaccgggacctaccgggttaccgttttatttcgtcggttcggtacggacgggtacgtacggtaccgttcgggtttactttaccgtaaagtttccggttaacggttccgggggtcccgttacggggtacccctaacccgggtttcgggttaacccttaccgtttccggttcccttaccccgttcggtaaccttccccgtttaccccggaaacccggtaacccggggtccccctaacggttttccccccggg

SEQ ID NO: 363560 - DNA, 565 bp, Homo sapiens
  misc_feature: GZ8MTXP02I3JZR.44.86.H09.1.454.CMB.2.raw
  modified_base (351)..(351): a, c, t, g, unknown or other
  modified_base (363)..(363): a, c, t, g, unknown or other
  modified_base (531)..(531): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatcggcacgcccccgagggacggggaatggaggtggagttggtgacatccattatacgtggggcacgtactactctcgtcccctcaagngtcgtctcaccntttcgagggacacgtccatgaaaccgtcttctccctagaaactcgaacccgtccgtcgacccgccgcgaccacggtcccgtttattcgtgtagcggaggcgagacttggtctttcaattctagtcggggtaccgtggcctaccctgggtctacgttcgtcctccgtcncgtacttcccacgtaacgggccctacgttcccgg

SEQ ID NO: 363561 - DNA, 591 bp, Homo sapiens
  misc_feature: GZ8MTXP02JUTZ3.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccgagggagggagtggagtggagttggtgacatccattatacgtggggcgacgtactactctccgtaccccctcaagtagtccgtctcacctactttcggagggaccacgtccacgtacgaacccgtcttcctccctagaaacctcgtaccctccgtacgacccggccgccgggacgccggtaccgttttattcgtcgttcgcggaggtcgagtactggttactttcgaacttccgtaagtcgggggtccgtgggcctacccgtggtacctcgtcgtctccgtccgcgtacctaccgaccgacgcccgtacgtccg

SEQ ID NO: 363562 - DNA, 580 bp, Homo sapiens
  misc_feature: GZ8MTXP02HFT1B.44.86.H09.1.454.CMB.2.raw
  modified_base (373)..(373): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcgttggggctggatccggcacgcccccgaggggacgggaatggagtggagttggtgacatcctattagtacgtggggcgacgtactactcgtccgtcccctacaagacgtcgtctcacctntttcgaggactacgtaccatacgaaccgtcttcctacccgtagaaacctcgtaaccctccgtcgacccgccgcgaccgacggtcctttattctgttgcgaggcgagacgtggtcttcagttctaggtcgggtcgtcgccgtaccgtgtcctacgtcgtcctccgtcgtacgtccttaccaaccgtaccgggccctacgtttccccgg

SEQ ID NO: 363563 - DNA, 631 bp, Homo sapiens
  misc_feature: GZ8MTXP02G6MBV.44.86.H09.1.454.CMB.2.raw
  modified_base (362)..(362): a, c, t, g, unknown or other
  modified_base (367)..(367): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatctagttctgtatctattcgttggggctggactccggcacgcccccgagggacggggaatggagtggagttggtgacatccattatacgtggggcacgtactactctcctcccctcatacgtctcncactnttcgaggtacactcagtacgaccgtcttacctcccgtagaaactcgacccgtcgtccggacccggccgaccggtaccgacgggttcccgtttaacgtttccgtggttcgcggtagggacgtaacgtacgttgggttacctttcgtaaacgttcgtacgggtcgggggtccgtcgggcccgtacccgttcgggtcaccgttcggtccttcccgtcgtcggtaccctttaccgaaccgtacccggtcccgtaacgtttcccccggg

SEQ ID NO: 363564 - DNA, 549 bp, Homo sapiens
  misc_feature: GZ8MTXP02HRWCO.44.86.H09.1.454.CMB.2.raw
  modified_base (374)..(374): a, c, t, g, unknown or other
  modified_base (395)..(395): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcggggaaccctgtctctcatctgcactgtctctggagttttccatcagttctgatcattcttggggctggatccggcacgcccccgagggaggggaatggagtggagttggtgacgatccattatacgtggggcgacgtactacgtctccgtccccctacaagtacgtcgtctcgaccntttacgaggacacgtccagtnaacccgcttctcctagaaactcgacctcgcgacgcgacgacacgccgtttattctgtgcgaggcgagacgtggttctactaagtctagcggggtctggccaccctggtcactcgtctccgctacgccttaccaccgacggccctagttccccgg

SEQ ID NO: 363565 - DNA, 611 bp, Homo sapiens
  misc_feature: GZ8MTXP02JS9FH.44.86.H09.1.454.CMB.2.raw
  modified_base (379)..(379): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcatttcgtggggctggatccggcacgccccgagggaggggaatggagtggagttggtgacgatcctaagttagtacgtggggcgtacgtaacctacgtcctccgtccccctcgaagtcgtcgtctcacctnttcgaggtacacgtcatcgaaccgtcttctccctagaactcgacccgtcgtcgaccgccgcgacgacggtcctttagttcgtagtcgcggaggcgacgtacgtcggttctttacgaacttacgtagtcgggggtccgtcgggaccctcccgttacggtcctaaccgtcggtcccttaccgtccgtacggtccttacccgaccggtaaaccggccccgtacgtttcccccggg

SEQ ID NO: 363566 - DNA, 639 bp, Homo sapiens
  misc_feature: GZ8MTXP02IWKB9.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtatttccatctagttctgattctagttcgttggggctggatccggcacgccccgagggagggatggagtggagttggtgacagtcctagttacgtacgtggggacgtacgtactactcctcccgtccccctacgaagtcgtcgtctccactcgtttcggacggaccacgtccagtcgtaaccctcttcctcctacgaactcgtacccgtcgtaccggacccgaccggccgtaccgtaccggttaccgtttactttccgtaggttcgcggtacgggcgtacggtacgttggttactttacgtaacgttacgtagggttcggggtccgttacgggccctacccggtggtacctccgttcgttccgtcctcgtactccgtacccaccggaccggtacccgtcgtttcccccgg

SEQ ID NO: 363567 - DNA, 602 bp, Homo sapiens
  misc_feature: GZ8MTXP02FNBNC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcttggggctgaactccggcacgcccccgagggagggaatggagtggagttggtgacatccattatacgtggggcgacgtactactctccgtccccctacaagacgtcgtctccactcttacggaggacacgtccatcgaacccgtcttctccctagaaacctcgacccttccgcgacccgccgacgaccacggtccgtttattcgtgtgccggaggcgagtacgttggttacctttacgaaagttcgtagtcggggtccgttggcccgtaccgttcggtctaccgttcgtccttaaccgtcctaacggtcccttaccgaaccgaaaccgggtccctacgtttcccccgg

SEQ ID NO: 363568 - DNA, 616 bp, Homo sapiens
  misc_feature: GZ8MTXP02I7AE2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtatttccatctagttctgatctattcgttggggctggactccggcacgcccccgaggggagggaagtggagtggagttggtgacatcctattatacgtggggcgacgtactactcctccgtcccctcaacgacgtcgtctccacctgtttcggacgggaccaccgtccatacgaacccgtcttcctccctagaaactcgaccctccgtcgacccgccgcgacgcggtaccgtttattcgtcgttgcgagggcgagtacgttcggtctttacgaattcgtaggtcggggtccggtaggcccgtacccgttgggtacctacgttcggttccttcccgtcgtacggtccctttaacccgaccgaaaccgggtcccctacgtttcccccgg

SEQ ID NO: 363569 - DNA, 680 bp, Homo sapiens
  misc_feature: GZ8MTXP02F4LAE.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtccaggtgcagctgcaggagtcgggccaggactggtgaggccttcgggaaccctgtctctcatctgcactgtctctggtagttccatcagttctgatctattcgttgggtctggacgtccggcacggcccccgaggggacgggatggagtggtagttggtagactagtcctaagttacgtacgtggggacgtacgtactactccgtccgtccccctacgaacgtacgtccgtctaccacctagtttcggacgggtacctaccgtaccagtacgtaaacccgtcttacctcccgtaagaaaccttcgaacccttccggtacgcccggtccgacggaccgtacggttaccgttttacttcgtcggtacgcggtacggacgtacgtacgttggttctttacaacgttacgtacggtcggggtaccgtcgggtcccgtacccggttcgggtacctacgtttccggtccctttcccgtaacgtacccgttacccgttacccgacccgtaaccggggaccccttacggtttcccccgg

SEQ ID NO: 363570 - DNA, 595 bp, Homo sapiens
  misc_feature: GZ8MTXP02JSTSX.44.86.H09.1.454.CMB.2.raw
  modified_base (366)..(366): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccgagggacggggaatggagtggagttggtgacgatcattatacgtggggcgacgtactactcctccgtccccctcaagagtcgtctcaccntttcgacgggacacgtccatcgaaaccgtcttcctccctagaaaccttcgaacccttcggtcgaacccgtccgcggacactcgcccttttattccgtgtcgcggaggcgtacgtacgttggtctttcgaaagtcgttaaggtcggggtccggttggacccgcccgttcgggtcctacgttcgtcctcccgttcgacgtcccttccgaacccgtaacgggtccctaccgg

SEQ ID NO: 363571 - DNA, 593 bp, Homo sapiens
  misc_feature: GZ8MTXP02FP6FR.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtacgtttccatctagttctgatctattcgtgggctggatccggcacgccccgagggagggatggagtggagttggtcgacatacattagtacgtgggacgtacgtactactctccgcccctacaagagtccgtctacactgttcgacggacaccgtcatcgaaccgtcttcctacccgtagaaacctcgtacccgtccgtcgacccgccggcgaccgacggttaccgttttattccgtgtcggtcgacggcgtacgtacgttcggttctttaacacgttcgtaaggtcgggtcgtcgacctaccgtggtctacgtcgtcctccgtcgactcccttaccgacgtaaccggcctacgtttccccgg

SEQ ID NO: 363572 - DNA, 612 bp, Homo sapiens
  misc_feature: GZ8MTXP02H3TTB.44.86.H09.1.454.CMB.2.raw
  modified_base (420)..(420): a, c, t, g, unknown or other
  modified_base (451)..(451): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggacgtggtgaggccttcgggaaccctgtctctcatctgcactgtctctggtagtttccatctagttctgactctattcgttgggctggatccggcacgcccccgagggagggatggaggtggagttggtgactataccattacgtacgtggggcgtacgttactactccgtccgtaccccctcaagtacgtcgtctccactgtttcgaggaccacgtccatacgaccgtcttctccctanaaactcgaccctcgtcgaccgtccgacgacncggtctttattctggtcgcgaggcgagtacgttcggttctttacaatttcgtacggtcggggtccgtcggacccgtcccgtttacggctaccgttcgttcctcccgtccgtacggtacccttacccgaacccggtaacgggtcccctaacggtttccccgg

SEQ ID NO: 363573 - DNA, 620 bp, Homo sapiens
  misc_feature: GZ8MTXP02HS8A4.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggatccggcacgccccgagggagggaatggagtggagttggtgactatcctattatacgtggggacgacgtacctactcgtccgtccccctacaacgagtccgtctccactntttcggacggacacgtaccagtcgtaacccgctttctccctagtaaactcgacccttcggtccgaaccgcccggccggacgtaccggttaccgttttatttccgtggttcgcgggtacggcgtagtaccgttggtctttacgaattcgtagtcggggtcgtcggtcctacccgtcggtctcgttcgtcccttcctaacgtacgtcccttacccgaaccgtaccggccccgtacgtttcccccgg

SEQ ID NO: 363574 - DNA, 642 bp, Homo sapiens
  misc_feature: GZ8MTXP02HSGQA.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgtatctattcgttggggctggatccggcgacgccccgacgggagggagtggaggtgtagttggtgactatctattatacgtgggcgacgtactactctccgtcccctacgtaagtacgtccgttctccgtactacgtttcggaacggacgtacccgtaccgtactacggtaaacccgtccttacctaccccgttagtaaaaccgtcggtacccgttacccgtacggacccgacccggaccggaccgtaaccggttccggttttactttcgtcggtggtacggagggccgagtacggttcggttcttacgtacgtacgtgggtacgggcggtcgtccgacccttggtctcgctcctctcgacgtccttaccgaccgtaacggtccctacgttcccgg

SEQ ID NO: 363575 - DNA, 690 bp, Homo sapiens
  misc_feature: GZ8MTXP02J2O2O.44.86.H09.1.454.CMB.2.raw
  modified_base (402)..(402): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatcagttctgatcattctgggctggatccggcacgcccccgagggacggggaatggagtggagttggtgacagtccattacgtacgtggggcacgtactactctaccgtccccacagtacgtcgtctccactcgtttcggaacgggaccacgtccagtacgaccncctttcctaccctagaaaccttcgtaaccctccggtacgacccggtccgaccggtaccgaccggttacccgttttaagtttccgtggttcggacgggtacgggacgtacgaaccggtttggttacccttttacgtaaacgttcgtaacgggttcgggggtcccgttacgggggaccctaacccccgggttgttacccgtaacgtccggttaacccttaccccgtccgtacgtacccgtttacccgaaacccggtaacccggggtaacccctacggtttccccccgggg

SEQ ID NO: 363576 - DNA, 608 bp, Homo sapiens
  misc_feature: GZ8MTXP02HNTP7.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgactctattcgttggggctggactccggcacgccccgagggagggatggagtggagttggtgacatccattagtacgtgggcgtacgtactactcctccgtcccctcgaagcgtcgtctccactgttcgaggacacgtccagtcgaaccgtcttctaccctagaaacctcgacccgtcgtcgacccgccgccgacgtaccggtccgtttatttccgtggttcgcggacgggcgacgtacgttcggttacttacgaagttcgtacggtcggggtccgtacggtccctacccgttcggtcctaccgttcgttcctccgtaacgcgtaccttacccgaccgaaccgggtccctacggtttccccgg

SEQ ID NO: 363577 - DNA, 589 bp, Homo sapiens
  misc_feature: GZ8MTXP02I94NT.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgacggtccttcgggaaccctgtctctcatctgcactgtctcgtggtatttccatctagttctgatctattcgttggggctggactccggcgacggcccccgaggggacggggatggagtggattggtgacagtccattagtacgtggggacgtacgtactactctccgtcccctacagcgtcgtctcactgttcgagggacacgtccatcgaacccgtcttcctccctagaaactcgacccgtcgcgtaccgccgcggacgcgtccgtttattctggtgcggaggcgacgtacgtggttctttacaagttcgtaggtcggggtccgtggcctaccggtggtacctcgttcgtcctccgtcgtacgtccttacccaccgaaccgggtccctacgtttccccgg

SEQ ID NO: 363578 - DNA, 613 bp, Homo sapiens
  misc_feature: GZ8MTXP02GONU7.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagcagtagtagttactactggggctggatccgccagcccccagggaaggggctggagtggagttggggagtatctaattagtaggtgggagcacctactaccaacccgtcctacaagagtacgagtcaaccatactcaagtacgacaccgtaccaaacgaaccaagttcctaccctagaaacgcttagacgcttcgtgtcgacccgccgacggaccaacgggtcccgttagtacttacgtgtacgcgaggtaggtaagggctacggttcgaccaaccgtaacttactttacgacctacggttcggggacccaacgggggtaaaccctgggtacctaacccggttcctcccgtacgaacggtccctaaccccgg

SEQ ID NO: 363579 - DNA, 679 bp, Homo sapiens
  misc_feature: GZ8MTXP02JEEOB.44.86.H09.1.454.CMB.2.raw
  modified_base (282)..(282): a, c, t, g, unknown or other
  modified_base (286)..(286): a, c, t, g, unknown or other
  modified_base (310)..(310): a, c, t, g, unknown or other
  modified_base (628)..(628): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggccgtgggagtccctgagactctcctgtgtagcgtctggtattcaccttnaacngacatggcatgccacgtgggtccnccaggcctccgaggccaaaggggactgggaggtggggtcggactaacgtttatagtgggtaatggaattaggggaaaattaaattaaagttatttaagtacggttaagtactttccgggagggtaaaccgggggtcctaatttccgaaccctattccgacccgaagacgaactaaagttaccggaaaagaaccaacctaacttaataactttacgtaagggtaaaattacgaaaagttacggaccttagggaacggacggacccggaagggaaccctaggggcctttaggaccctttaaacgtccgttaggttacggnggtaaacggcggtagggtcggggtacgttacgggtacggtaacgtacgtag

SEQ ID NO: 363580 - DNA, 607 bp, Homo sapiens
  misc_feature: GZ8MTXP02GGG4S.44.86.H09.1.454.CMB.2.raw
  modified_base (277)..(277): a, c, t, g, unknown or other
  modified_base (304)..(304): a, c, t, g, unknown or other
  modified_base (335)..(335): a, c, t, g, unknown or other
  modified_base (344)..(344): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctctgtgtagcgtctggattcaccttnaacagacatggcatgcacgtgggtccnccaggcctcgaggcgaagggctggagtgggngctacttanatggtatgataggaaattaataatattatagtagtactttccggtaggaaacgggccctagttaccacctatacctacccaaggacgtaaactaagttaacgaaaacgaaaccaaacctaacttaaacttaacttacgtaaggaaaattagaaaacttacggaccttaaggacgacggacccggaggaaccgtacgggcttacggtaccttacgtacgttgacgacgaggaagtaggtcgggggtctacggttagatacgaag

SEQ ID NO: 363581 - DNA, 647 bp, Homo sapiens
  misc_feature: GZ8MTXP02GML04.44.86.H09.1.454.CMB.2.raw
  modified_base (283)..(283): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcaccttcaacngacagtggcatgcacgtgggtcccgccgaggcctaccgaggacgaaaggggactggggacggtggggtacgctaacgtttatagtagggtatggaactaggggtaaaagttaaattaaagttatttaagtacggttaagtactttaccgggtaggaaacggggtccgtaatttaccaacctaacgttcctaacccgaagaacgtaactaaagttaccgaaaagaaccaactaactattaactagaggtaaaatagaaatacgaccgtaggaaacgacggaccggacggaacgtacggcttacggtacctaaacgtcgttaggccgagtaaggaagacggttggggaccttggagacgtacgaag

SEQ ID NO: 363582 - DNA, 568 bp, Homo sapiens
  misc_feature: GZ8MTXP02H7KMN.44.86.H09.1.454.CMB.2.raw
  modified_base (266)..(266): a, c, t, g, unknown or other
  modified_base (277)..(277): a, c, t, g, unknown or other
  modified_base (281)..(282): a, c, t, g, unknown or other
  modified_base (284)..(286): a, c, t, g, unknown or other
  modified_base (289)..(289): a, c, t, g, unknown or other
  modified_base (303)..(303): a, c, t, g, unknown or other
  modified_base (316)..(316): a, c, t, g, unknown or other
  modified_base (319)..(319): a, c, t, g, unknown or other
tcagacagtatatacacgaccggtgctcgatttagtgctatagacttggggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggaggcgtggtccagcctgggagtccctgagctctctgtgtagcgtngtatcactcangacnngnnngcncgcggccgcgcgcncacgacgaggagnggnggtggtgctactatagtagtagtgagtagtaagtaatataattatagtagtagttacgtaggacggacgtactactacctactacacagacgaactaactaacgaaacgaaacaacaactaataatagtaagtaaagtaagtaagtacgtacgtagagacggacggacgaacgacgtacgtacgtactactacgtacgtacgacgaggaaggacggtacgggtacggtacggtacggtacgtaacgaag

SEQ ID NO: 363583 - DNA, 610 bp, Homo sapiens
  misc_feature: GZ8MTXP02HH1A5.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcttggggctggatccggcacgcccccgagggacgggaagtggagtggattggtgacatcattatacgtggggcacgtactactctccgtccccctcaagacgtcgtctaccacctagtttcgaaggggacctaccgtcccaagtacgaaacccgtcctttctacccccttagaaaacctcgaacccgtcccgtcgacccgccggaccggacgacccggtccgtttatttccgtgtgtcgagggccgagacgttcggtctttcgaaacttcgtaacgtcgggggtccgtcgggcctacccgtggtccacgttcgtcctccgtcacgtccttacccacccgtaaccgggccctacgtcccgg

SEQ ID NO: 363584 - DNA, 893 bp, Homo sapiens
  misc_feature: GZ8MTXP02J0RT8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgatctattcgttggggctggactccggcacgccccgaggggagggaatggaggtggagttgggtacgactatcctaagttacgtacgtacggggtacgacgttaaccgtacctcccgtacccgttccccccgtacgaaacgtacgttaccgttcctaccaaccctacgtttaccggacggggtaacctaccgtaccctaacgttaccgtaaaccccggtcccttttacccgtacccccttaacgggtaaaacccttcccggtaaccccgttaccccgggttaccgggaaacccccggtccccggggtacccgggtaacccggtaacccggggtttaccccggttttttaaattttcccgggtgggttacgggtaccgggtaacgggggtacccggttaacggtaccggtttaccgggggtttacctttttaaccgtaacgtttaccgttaaacgggggttcccggggggttccccggttaaccgggggtccccgttaacccccgggtttcggggtttacccgttaacccggtttaccggttcccctttaccccgttcccggtaaacccgggtttccccctttaccccggtaaaacccccggtaaacccgggggttacccccgtaaccggtttttcccccccggggg

SEQ ID NO: 363585 - DNA, 688 bp, Homo sapiens
  misc_feature: GZ8MTXP02HYN2D.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgctactgtctcgtggtacttcctatcgtagttctgtattctattcggtcgggctggtacgtccggcgaccggaccccggaggggacgggtagtagggtaggtaggtagttggtagaactataccgtaagttacgtacggtcgggacgtacgtaaccttaccgtccgtccgtaccccctaacgaacgtcgtacctctaccacgttacgttacgggaacgacctaccgtacctagaaccggtaccctaccttccgaccctaagtaacctccgacccgttacgaccgcccgacccggaccggtacgtaaccgttccgttttaacgtttcgaggttcgcggtacgggcgtaagtccgttggtttactactaacgtcgtaacggtccggggtcgtcgtcccgtacgtcggtccttaccgtcgttcccaccgtcgtaccgtacctacccgtaccgtaaccggccctttacggttcccccg

SEQ ID NO: 363586 - DNA, 603 bp, Homo sapiens
  misc_feature: GZ8MTXP02G9KGE.44.86.H09.1.454.CMB.2.raw
  modified_base (430)..(430): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggacgtttccatctagttctgatcattcgttggggctggatccggcacgcccccgaggggacgggaagtggagtggtagttggtagacgatccgtaattagtacgtggggacaacggttactaacgtcctccggtccccctacaagtacgtcgtctaccacctgtttcggaggtaccacgtccatcgaaccgtcttctccctanaaactcgaaccctcgtcgaccgtccgcgacgaccggtctttactttcgcgtgcgtaggcgtagtccgtggttaccttctaacgtcttacggtcggggtccgttcggcctaccgttcggtactcgtcgtcctccgttcacgttcctaccgaaccacgggtcccacgtttccccg

SEQ ID NO: 363587 - DNA, 623 bp, Homo sapiens
  misc_feature: GZ8MTXP02HZN1T.44.86.H09.1.454.CMB.2.raw
  modified_base (316)..(316): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcggggaaccctgtctctcatctgccactgtctcgtggtacgtttccatctagttctgatctattcgttgggctggatccggcacgccccgaggggacgggaagtgggtagtggagtttggngaactatacctattactacgtggacgtcgtacgttactactcctccccgtccctacagtacgtcgtacctcacctatttacggacggaccacggtcatacgaacccgtcttacctccctagtaaacctcgtaaccgttccgtacgaccgccgtcgacgtacggttccgtttatttcgtgtcggacgacggcgacgtacgtttcggttacttacgtaaatcgtaaggtcggggtccgtaggcccgtaccgtcggtctacgttcgtacctccgtcacggtccttaccgaccgtacgggtacccttacgg

SEQ ID NO: 363588 - DNA, 636 bp, Homo sapiens
  misc_feature: GZ8MTXP02GSHO0.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgcccccgagggacggggaatggaggtggagttggtgacagtcctattatacgtggggctacgtactactctccgtccccctcaagtagtcgtctcacctgtttcgagggtaccaccgtccatcgaaacccgtcttcctccctagaaacctcgaaccctccgtcgacccggccggaccggacaccgggtcctttattccgtgttcgcgtacgggtcgagtacgttcgggttctttacgaacgttcgtaacggtcgggggtcccgttcgggtcccgtaaccccggttgggttaccctacgttccgttccttacccgtctacggtccctttaccgaccgtaaccggggcccctaacgtttcccccgg

SEQ ID NO: 363589 - DNA, 651 bp, Homo sapiens
  misc_feature: GZ8MTXP02GMYNS.44.86.H09.1.454.CMB.2.raw
  modified_base (117)..(117): a, c, t, g, unknown or other
tcagacagtatatacacgaccggtgctcgatttagtgctatagacttgggtttggggatgctttctgagagtcaaggacctcctgtgcaagaacatgaagcacctgtggtttttccncctgctggtggcagctcccagatgggtcctgtcccaggtgcagctgcaggagtcgggcccaggactggtgaggccttcgggaaccctgtctctcatctgcactgtctcgtggtactttccatctagttctgatctattcgtgggctggatccggcacgccccgagggacgggagtggagtggagttggtgactatcctaattagtacgtggggacctacgttacctacctccgtccgtccccctacgaagtacgtcgtctccacgtgtttcgaggtacaccgtccagtacgtaacccgtcttaccgtaccctagaaacctcgtacccgtccgtaccgacccgtccggaccgtaccgtaccggttaccgttttattcgtacggtcgcggacgggtcgacgtacgttcgggttctttacgagttacgtagtcggggtacctggtaccctacccggttggtcctacgttcgtacccgtttccaaccgtcgtaccccgttacccaaccggtaccggtaccccgtacgtttccccccgg

SEQ ID NO: 363590 - DNA, 651 bp, Homo sapiens
  misc_feature: GZ8MTXP02GP8R5.44.86.H09.1.454.CMB.2.raw
  modified_base (351)..(351): a, c, t, g, unknown or other
  modified_base (383)..(383): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcagcatctcctgcagttgggagcggctaccaacgaggcggggcgtaggttttgagtgttcagtggtacagcaactccaggaacacgacccccaaactcgctactactttaccgactaaccacctacgttccggccctcgacggggtcccncgtaccgacttccagacgtcctaccaagttcncgggccacctccacgccctccgtcggcccatccacgtcgggcctaccgaggtcgtacggaggtatacgggaggtccttaggtaatttaacgttacgttacggaccctaaacggtacccttaagtacgaacgttaggtacgttacgtggtaagttcggttcggtttcggggttacgggttccggggacgggtaacggggaacgtaacggtcggtaaccgtaaccgttacggtaccggacgaccccgtaacggcccgtaccgtcccccgg

SEQ ID NO: 363591 - DNA, 623 bp, Homo sapiens
  misc_feature: GZ8MTXP02FIQD6.44.86.H09.1.454.CMB.2.raw
  modified_base (582)..(582): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatctattctggggctggatccgggcacggcccccgagggacgggaagtggagtggagttggtgacatccattatacgtggggcgacgtactactccgtccgtccccctcgaagagtcgtctaccaccgtattaccgagggtactaccgtacctatcgaaacccgtcgttacctccctacgaaacctcgtaacccgtcccgtacgtacccgccggccggaccgtccggtaccgtttacgttccgtggtcgccggagggacgacgtacgttcggttctttacacgttacgtaggttcggggccgttggccctacccgtcggtcctacgttcgccttccncgacgtcctacccgtaccgaacgggcccctacgttccccgg

SEQ ID NO: 363592 - DNA, 822 bp, Homo sapiens
  misc_feature: GZ8MTXP02GVY3W.44.86.H09.1.454.CMB.2.raw
  modified_base (225)..(225): a, c, t, g, unknown or other
  modified_base (255)..(255): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccactctgtgctgacgcagcccgccctcagtgtcgtcggggccccggggcaggacgggtcaccatctcctgcacgtgggancagactacccaacagtcgggacagtattcnggatcgtccactggtaaccaactacccttaccgaacggaaccaacccgacccccctaaactcccttacgaacttccgttttaacggaaacctaaaccttaacgtcccgggtacccccttacggtaccggggttacccctcggaacccggttaactttccccgtcccgtcgggtacccttacccgaaacggtttccctcggggtaccctaacccgttcgacccgttccccccgttcccgttacgggaccccctaaacgttcccgaacggttccggtaccctccggacggtccgtaaggtaaaccgtggttaacgggtacggggtaattacggtttaaactttccgtacggtacccgttaacggttcctaacggtacgaacgtaaccgcgtacgtaccgttaacggttggggttcgggggttcgggggttacgggttaccgggggaacgggggtaaccggtaaaacccgtcgggtacccggttacccggtaacccggttccggggttaacggtacccggaaccggttaccccgggagtcccccggtaacccgtcccccggtttacccgg

SEQ ID NO: 363593 - DNA, 692 bp, Homo sapiens
  misc_feature: GZ8MTXP02I94BP.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattcaccttcaacagacatggcagtcgcagtcggggtccgccgaggtcctccgaggggccgaaagggggacttggggaacggttgggggtggaccgtaactttaagtacggttaggggtatagggtaagttaggggaaaagttaaataaagtttatttaaagtgttaaagtacgttttccggagggaaacgggggtcccgtaatttacccgaacccgtaattccgttacccaaggtaacgaaacttaaacgttaccgaaaacgaacaaacctaaccttaaataacttaccgtaaggaaaattagtaaaagtacgaccgtaggaacggacggaccggaaagggaccgaacgggcgttagtaccgtaacgtacgttcgtagacgaagaaggagtcgggggaccttgggacggtatacgtaagg

SEQ ID NO: 363594 - DNA, 720 bp, Homo sapiens
  misc_feature: GZ8MTXP02JFWFU.44.86.H09.1.454.CMB.2.raw
  modified_base (319)..(319): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtcctgagctctctgtgtagcgtctggacttcacccttcaaacagtacagttcggaccatgccacgttcggggtacccnccgaggcctacccgagggcccaaaggggaccttggggaagttcggggtagcctaaacgtttatacgttgggttaatggtaagtagggtaaaagttaaataacgttattaagtcggtaaagtgtttacccggtagggaaaccgggggccctaatttacccgaaccgtattcccgtacccaaaggtacgaaacctaaagttaaccgaaaagaaaccaacgtaacctaattaagttaccgtaagggtaaaattacgaaagttaccggacctaggggaacgaacggacccggtaaagggacccgtacggggtactttacggtaccctaacgtttaaccgggcggtacggacggtaaggaacgggtacggttcgggggtaccgttaggggtaggtacgtacggacg

SEQ ID NO: 363595 - DNA, 607 bp, Homo sapiens
  misc_feature: GZ8MTXP02FK36E.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtccgggcccaggactggtgaggccttcgggaaccctgtctctcatctgcactgtctctggtagtttccatcagttctgatctattcgttggggctggactccggcacgcccccgaggggaggggaatgggagtggattgggtgacgatccattatacgtggggacgtacgtactactccgtccgtccccctcaagagtcgtctcacctgtttcgagggacacgtccatcgaacccgtcttcctccctagaaacctgaaccctccgtcgacccgccggcggacaccggttccttttagtccgtggtcgcgagggcgagtacgtggttctttcaaagttcgttaagtcgggggtcccgtgggccctacccgtgggtacctacgtcgtcctcccgtctacggtcccttacccgaaccgtaaccggggccacgtttccccgg

SEQ ID NO: 363596 - DNA, 731 bp, Homo sapiens
  misc_feature: GZ8MTXP02J1DB7.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgctactgtcttcgtggtacgtttccattctagtttcctgtatctagttcgttggggtcgtggactccggcaccggccccggaggggacgggtaagtggtaggtggtagttggtacgtaactactacctaagttacgtacggtggggtaccgtaccgtactaccgtccgtaccgtcccccgtacgtaacgtacgtccgtctaccaacgtcgttacggaacgggacctacgtaccgtaacgtaccgaacccgtacccttccctacccgtaacgtaaaccgtccgtacccgtccggtaccgacccggcccgaccggtaccgtaccggttacccgtttacgttcgtacggtcgacggtacgggtaccgtagtaccgttcggttacctttactaacgttcgtaacgggtcggggtaccgtcggtacccaccggttacgtccgtaaccgttccggtaacctttcccgaacgtacccgtacctaccccgtaaccggtaacccggtcccgtacgtttacccccgg

SEQ ID NO: 363597 - DNA, 587 bp, Homo sapiens
  misc_feature: GZ8MTXP02IZP0F.44.86.H09.1.454.CMB.2.raw
  modified_base (443)..(443): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggactccggcacggcccccgagggacggggaagtggagtggagttggtgacatcctattagtacgtggggacacgtactactctccgtcccctacaagtacgtcgtctcactgttcgaggactacgtccagtcgaaccgtctcctccctagaaactcgacctcgtcgaccgccgacgacncggtcgtttattcgtgtgcgaggcgacgtcgttcggttcttactactcgtacgtcggggtcgtcggcctacccgtggtcctacgttcgtcctacctcgaccgtaccttacccgaacccgaaccggtccctaacggtttccccgg

SEQ ID NO: 363598 - DNA, 574 bp, Homo sapiens
  misc_feature: GZ8MTXP02IH2HK.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacgccccgagggagggaatggagtggagttggtgacagtcattatacgtggggcacgtactactctccgtcccctcaagtcgtcgtctcactgttcgacggtacacgtccatacgaaccgtcttctaccctagaactcgaccctcgtacgacccgtccgacgacacgtcgtttattctgtgcgacgggcgagacgttcggttcttacgaattcgtagtcgggggtcctagggcctacccgttgggtcctacgtcgtctcctcgtacgtccttaccgaacccgtaacggtccctacgtttccccgg

SEQ ID NO: 363599 - DNA, 568 bp, Homo sapiens
  misc_feature: GZ8MTXP02JK3FX.44.86.H09.1.454.CMB.2.raw
  modified_base (474)..(474): a, c, t, g, unknown or other
  modified_base (476)..(476): a, c, t, g, unknown or other
  modified_base (479)..(479): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatcagttctgatctagttcgttggggctggactccggcacggcccccgagggacggggaagtggagtggagttggtagacatctattagtacgtggggacgtacgtactactccttccgtcccctcgaacgtcgtacgtctaccacctgtttcgaacggggtacctacgtccagtacgaacccgtccttctccctgaaactcgacctacgcgaccgcgcgacgcgtcttatctgtcgngngangacgtgtcttgatcgtagtcgggcgtcgcgacctggtcctacgtcgtcctctcgacgtcctaccgaccgaacgggccctacgttccccg

SEQ ID NO: 363600 - DNA, 589 bp, Homo sapiens
  misc_feature: GZ8MTXP02FTGN3.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgaggggacggggaagtgggagtggtagttggtgacatccattatacgtggggcgacgtactactcctccgtcccctcaagacgtcgtctcactgttcgaggaccacgtcatcgaaaccctccttctccctacaaactcgacctccgtcgacccgtccgcgaccgtacggtccgtttaattcgtgtcgcggagggacgacgacgttggtcctttacgaacttcgtagtcggggccgtggcctacccgttggtactacgtcgtcctcctcgtacgtccttacccgaccgtaaccgggccctaacgtttccccgg

SEQ ID NO: 363601 - DNA, 644 bp, Homo sapiens
  misc_feature: GZ8MTXP02H5PIU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggacgtggtgacggccttcgggaaccctgtctctcatctgcactgtctcgtggtagttccatctagttctgatctattcgttgggctggactccggcgacgcccccgaggggacgggaagtggagtggagttggtgactagtcctaagttacgtacgtggggacgtacgtacctactcctccgtcccctacgaagtcgtcgtctacactgtttacggaggacctacgtctacgtacgaacccgtccttcctccctagaacctcgaccctccgtacgcccgtcccgacggactacggtcctttacgttctggttcgacggaggaccggtagtaacgtggttcctttacgaaacttgtaacggtccggggtcgtaccgggtcctaaccgtcggttcctacgtccgttcctcccgtcgtacgtcccgtttacccgaaccggtaacccggtacccctaacgtttcccccgg

SEQ ID NO: 363602 - DNA, 640 bp, Homo sapiens
  misc_feature: GZ8MTXP02FV0Q4.44.86.H09.1.454.CMB.2.raw
  modified_base (284)..(284): a, c, t, g, unknown or other
  modified_base (308)..(308): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccaggcctgggagtccctgagactctctgtgtagcgtctggattcaccttcaaacngacatggcatgcacgtcgggtccnccaggcctaccgaggcaaaggggctggggaggtggggtggactaacgtttatagttggtatagagttaggaaaagttaaattaagtatttaagtggttaagtagttaccggtaggaacggggtaccgtaatttacccacctactacctacccgtaagacgtaaactaaacgttacgaaaacgaaaccaaactaaactaataactacgtaaggtaaaatagaaatagaccgtagaagacggaccggaaggtaaccgacgggactacggtaccttaacgtaacgtggtacgaccggtaaggaaggaggtcgggggctcggtaggtactacgaag

SEQ ID NO: 363603 - DNA, 778 bp, Homo sapiens
  misc_feature: GZ8MTXP02HU5H4.44.86.H09.1.454.CMB.2.raw
  modified_base (248)..(248): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggacgtggtgaggccttcgggaaccctgtctctcatctgcactgtctctggtagtttccatctagttcngtatctattcgtgggctggactcccggcaccggccccgaggggagggaagtggaggtggtagttggtgacatcctaattacgtacggtaggggtacgtacgtaccgttacctccgttaccccgtccccctaacgtaacgtacgttccgttaccgtacctaacccgttacgtttaccgggaacgggtaccgtaacccgttacctaacgtaccgtaaaccccgtcctttacccgtacccttaacgtaaaacccgttccgtaaccccgttacccggtaccgacccccggacccgggtaacccggaccggttacccgggttcccgtttttaaacgtttccggttacggttcggaccgggtacgggtaccggtacgtaccgggtttcggttaaccttttaccgtaaacgtttccggttaacgggttccggggtccgttaccggtccccgtaacccgttcgggaccttaccgttcgttccctcctcgtaccgtcccgttacccgaaccgtaacccgggtcctaccgtttcccccgg

SEQ ID NO: 363604 - DNA, 702 bp, Homo sapiens
  misc_feature: GZ8MTXP02F2GEU.44.86.H09.1.454.CMB.2.raw
  modified_base (312)..(312): a, c, t, g, unknown or other
  modified_base (411)..(411): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccaggcctggggagtccctgagctctcctgtgtacgcgtctggattccaccttcaaacagacatcggacatgcacgtcgggtccnccaggcctcccgaagggccgaaaggggacctgggacgggttggggtcggactaacgtttatagtgggtaatggaattacgggaaaagttaattaaattnttagtacggttataacgtttccggaagggaacgggtacccgtatttacccgaaccatacccgttacccgaaaggacgtaaacctaaagttaccggaaaacgtaaccaaacctaacttaattaaacgttcgtaaagggtaaaaacttagggtaaaacttacggtacccttaagggaaacggaccggacccggaagggaaaccgtaccgggtacgttacgttacgttaaacgttaacgtcggtacggacggagaacggtaacggttgggggacctggtaaggacttaacgaag

SEQ ID NO: 363605 - DNA, 598 bp, Homo sapiens
  misc_feature: GZ8MTXP02IWU0F.44.86.H09.1.454.CMB.2.raw
  modified_base (354)..(354): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggatccggcacgccccgagggaggggatggaggtggagtttggtgactatcattatacgtggggctacgtactactctccgtccctcaagntcgtctcactgttcgacggacacgtccatcgaacctcttctccctagaaactcgacctccgcgaccgccgacggacgaccggttcgtttactttcgtagtcgacgtgggacgtacgcgttggttcctttagtaacttcgtagtccgggggtacgtcgggtaccctaccggttggaccttacgtcgttacctcccgtcgacgttacccttcccgaaccgaaccgggtccctacgtttcccccggg

SEQ ID NO: 363606 - DNA, 668 bp, Homo sapiens
  misc_feature: GZ8MTXP02HT308.44.86.H09.1.454.CMB.2.raw
tcagacagtatatacacgaccggtgctcgatttagtgctatagacttgggtttggggatgctttctgagagtcaaggacctcctttgcaagaacatgaagcacctgtggtttttcctcctgctggtggcagctcccagatgggtcctgtcccaggtgcagctgcaggaggtcgggcccaggactggtgaggccttcgggaaccctgtctctcatctgcactgtctctggtacgtttccatctagttctgatctattcgttggggctggactccggcacgcccccgaggggagggagtggaggtggagttgggtgacatacctattacgtacggtggggaccgtacgtacctacctcctccgtcctaccgaagtacgtcgtctacacctagtttcggaagggactaccgtccatacgaaccgtccttcctaccctacgtaacctcgaccctaccgtcgaccccggccgacggaccgtaccggtccgtttagtttccgtggtcgacggtacggcgtacgtacgttcggttcctttacgtaacgttcgtaacgggtcgggggtcccgttcgggtacccgtacccgttcggtacctacgttccggttccttccctcgaacgttcccttaaccccgaccggaaaccggtcccacggtttcccggtttcccccg

SEQ ID NO: 363607 - DNA, 744 bp, Homo sapiens
  misc_feature: GZ8MTXP02HZ5SZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgagccttcgggaaccctgtcctctcatctgcactgtctctggtacttccatctagttctgacttcattcgttggggctggactccggcaccggccccgaggggacggggtaagtgggaggtggtagttggtagaacaataccgaagttagtacggtggggacgtacggtaactacgttcccgtccgttccccgtacaacgtacgtccgtacttccaacctacgtttaccggaggtaacctacgtacctaacgtaccgtaaacccggtccttcccaacccgttaacgaaacctaccggtaacccgtacccggttaccggacccggtaccccgggtaaccggtacccggtaaacccgggttccgtttttaaaccgtttcggtacggtttaccggacgggacggggtaccgtaaaggttaaccccgtttgggttaccttttaacgtaaccgttcgttaaacggtcggggtaaccggtcggtacccgtacccgttggtaccgtacgtcgtcctccgttaacgacgtcctacccgaccgtaacggcccgtacgttcccccgg

SEQ ID NO: 363608 - DNA, 719 bp, Homo sapiens
  misc_feature: GZ8MTXP02G2F3Q.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctcgtggtatttccatctagttctgtactctattcgttggggctggacgtccggcacgcccccgaggggacgggagtggaggtggtagttggtgacgatacctaagttagtacgtcggggaccgtacgttaccgtacctccgtcccgtcccccctacgtaacgtacgtccgttctacccgtaaccttacgtttaccgggaacggtaccgtaaccgtcccgtaacgttaccgaaacccggttcccttccctacccgttaacgaaaaccttcgaccctcccggtaccgacccggtcccggaccgtaccgaccggttaccgtttacgtttcgtcggttgaccgggtacgggtacggaacgttaccgttggtttccttaacgtaacgtcgttacgggtcggggtacccgttcgggtaaacccgtcccgtcgggttaaccctcgttccgttcctacctcgtaactcccttaccgacccgtaacggcccgtacgttccccgg

SEQ ID NO: 363609 - DNA, 627 bp, Homo sapiens
  misc_feature: GZ8MTXP02I4RMZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgaggccttcgggaacctgtctctcatctgcactgtctctggtatttccatcagttctgatctattcgttgggctggatccggcacgccccgagggacgggaagtggagtggagttggtgacatcctaagttatacgtggggacgtacggttactacctcttcccgtcccctacaagtacgtccgtctacctacctagtttccgacgggtactaccgtccaatacgaaacccgtccttcctccctagaaactcgtaaccctcgtccgaccgcccggacgaccgcggtccgtttagttctacggtgtcggagggcgtacgaccgttggttctttacaagttcgtacggtcggggtaccgtcggccctacccggtggtacctaccgttcgtccttacctcgtacggtccttacccgaccgtaaacgggcccctaggtttccccgg

SEQ ID NO: 363610 - DNA, 583 bp, Homo sapiens
  misc_feature: GZ8MTXP02FV0V6.44.86.H09.1.454.CMB.2.raw
  modified_base (366)..(366): a, c, t, g, unknown or other
  modified_base (400)..(400): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcacttgtctctggtagtttccatcagttctgatcattcttggggctggatccggcacgcccccagggaggggaatggaggtggagttggtgacatccattatactggggcgacgtactactctccgtccccctcaacgagtcgtctcacntttcgaggacacgtccatcgaaccgcttctcccngaaactgaccctcgtcgaccgccgcgacacggtccgtttattcctgtcgcgaggcgagacgttggtctttacgattcgtagtcgggggccgttggggccctaacccgtcgggtctacgtcggttccttcccgtaacgtcgacctttacccgaacccgaacggggtaccccacgtttcccccgg

SEQ ID NO: 363611 - DNA, 695 bp, Homo sapiens
  misc_feature: GZ8MTXP02JGA3A.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgttgggctggactccggcacgccccgagggacgggatggagtggtagttggtgactatacctaattacgtacggtggggtaccgtacgttaacctaccgtcctccgtccccctacgaacgtacgtcgtctccacctagtttccggaacgggtaccaccgtacctaagtaccgtaaacccgtccttaccttacccgtagaaaaccgttccgaacccttccggtaccgacccggtcccgggaccgaacccgtaccgggttaccgttttaacgtttcgtcggtcggaccggtacgggtacgtaacgtaccgttcgggtttaccttacgtaacgttcgtaacggtcggggtaccgtacggggcctcccggtggtacctacgttccgttcctcccgtggaacctcccgttacccgaaccgaccgggtccctacgtttcccccgg

SEQ ID NO: 363612 - DNA, 643 bp, Homo sapiens
  misc_feature: GZ8MTXP02GB0S0.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctcgtggtacgttttccatctagttctgtatcatttcgttggggctggacgtccggcgacgcccccgaggggacgggaagtgggaggtggagttgggtagactatcctattatacggtggggaccgtacgtacctacgtccttccgtccccctacgaacgtacgtccgtctaccacctagttccggagggtacctaccgtaccagtacgaacccgtcttcctccctagaaactccgacccttccgcacccggccgacgaccgacggttccgttttacttcgtcggtgcggaggcgaacgcgttaggttccttacacgttcgtaggtcggggtcgtcggacctacccgtggtacctacgttcgtcctccgtaacgtaccgtccttacccgaaccgtaccggtaccccgcgtttcccccggg

SEQ ID NO: 363613 - DNA, 768 bp, Homo sapiens
  misc_feature: GZ8MTXP02JWNS7.44.86.H09.1.454.CMB.2.raw
  modified_base (289)..(289): a, c, t, g, unknown or other
  modified_base (313)..(313): a, c, t, g, unknown or other
  modified_base (320)..(320): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctgggtggagtcgtgggggaggcgtggtccaggccgtgggacgtccctgagctctctgtgtagcgtctggacttcacccttcaaacngacagtggcatgcacgtgggtccncaggtcnccgaggacgaagggtctgggaggtgggtgcctagttataggtgtatgaacgtgggaaaattaaataattagttactaggttagtacgtttacccggggtaagtaaaccggggtcccgtaatttacccgaaaccctattacccgtaacccgaaaggtaacgtaaaccgtaaacgtttaaccgggaaaacgtaaaacccaaacttaaacccgttaaattaacgtaaccgttaaaagggtaaaaacgttagggaaaactttaaccggacccgtttaagggaaacgggtaaccggaacccgggggtaaaacggaacccggtacggggtacccgttacgttaaacccgttaaacccggtttaaacggtacgggtaacggaaccgggtaaacggggtaacgggtaacgggttacgggggtaccgttaggggtaaacggtaacgtaaacggtaag

SEQ ID NO: 363614 - DNA, 565 bp, Homo sapiens
  misc_feature: GZ8MTXP02GFUBX.44.86.H09.1.454.CMB.2.raw
  modified_base (303)..(303): a, c, t, g, unknown or other
  modified_base (370)..(370): a, c, t, g, unknown or other
  modified_base (441)..(441): a, c, t, g, unknown or other
tcagacagtatatacacgaccggtgctcgatttagtgctatagacttgggtttgggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcggggaaccctgtctctcatctgcactgtctctggagtttccatcagttctgatcattcttgggctggatccggcagcccccagggagggaatggagtggagttggngacatccattatacgtggggcgacgtactactcctccgtccccctcgaagtagtccgtctacacctntttcgacggacacgttccatcgaaaccgtcttctccctagaaacctgaccctccgtgtacccgccgcgacncggtccgtttattctgtgcgaggcgaagtccgtggtctttacgatcgtagtcggggcgtggccaccgtggtcacgtcgtcctctcgacgtccttacccgactaacgggccctacgtttccccgg

SEQ ID NO: 363615 - DNA, 606 bp, Homo sapiens
  misc_feature: GZ8MTXP02FVBH8.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtagtttccatcagttctgtatctattcgttggggctggactccgggcacgcccccgagggacggggaagtggaggtggagttgggtagacatccattatacgtggggcgtacgtactactcctccgtccccctacgaagagtcgtctaccacctattcgacggggtacacgtccaatcgaaaccgtccttctaccctagaaacctcgaaccctccgtcgacccgccggcggaccgccggtaccgtttattcgtgtggcgacgggcgacgtacgttcgggttctttacgaaattcgtaggtcggggccgtggcctaccgtggtcacgtcgtcctccgtcgacgtccttaccgaccgtaacggccctacgtttccccgg

SEQ ID NO: 363616 - DNA, 595 bp, Homo sapiens
  misc_feature: GZ8MTXP02H7ORL.44.86.H09.1.454.CMB.2.raw
  modified_base (372)..(372): a, c, t, g, unknown or other
  modified_base (409)..(409): a, c, t, g, unknown or other
  modified_base (452)..(452): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggacggggaagtggagtggagttggtgacatcattatacgtggggcgacgtactactcctccgtcccctacagacgtccgtctccacctntttcgaggggacaccgtccactcgaacccgtcttccncccctagaaacctcgacccttccgtcgacccggcccgcggacncggtacccgttttatttccgtggtcgcggtagggcgagtactgggtctttacgattcgtagtcggggtcccgtggtcccacccgtggtaccacgtcgtcctcctcgacgtccttccgaaccgaacgggccctacgttccccgg

SEQ ID NO: 363617 - DNA, 669 bp, Homo sapiens
  misc_feature: GZ8MTXP02H94RQ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccccaggactggtgacggccttcgggaaccctgtctctcatctgcactgtctcgtggtagttccatctagttctgatctattcgtgggctggactccggcacgccccgaggggagggagtggagtggtagttggtgacgtatctaagttacgtacggtggggacgtacgtactaccgtcctccgtcccctacgaacgtacgtcgtctaccgtactcgtttcggaacggtacctaccgtacctaacgtacgtaaacccgtccttccacccgtacgtaaaccgtccgaacccgttcccgtaccggacccggcccggaccggtaccgtaccggttaccgttttactttccgcggttcgaccggtacgggacgtacgtacgttcgtttactttacgtaacgtcgtaggtccggggtccgtacggtccctaccgttggacctcgtcgtcctccgtaacgcgtaccgttaccgaccgtaaccggtcctaacgttcccccgg

SEQ ID NO: 363618 - DNA, 767 bp, Homo sapiens
  misc_feature: GZ8MTXP02H0QUI.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggttttcctcctgctggtggcagctcccagatgggtcctgtcccaggtgcagctgcagggagtcgggcccaggactggtgaggccttcgggaacctgtctctcatctgcactgtctctggtacgttccatctagttctgatctattcgttgggctaggcgtccggccaccggccccggaaggggacggggaagtgggtaggtggtagttgggtagaacgtataccgtaagtttaagttacgggtcgggggtacgacggttaccttacctccgttccccgtccccctacgaaacggtacggttccggttaccttaccgaacctcgttttacgggaacgggtaacctaccgttaccacgttacggtaaacccgttcctttaccgtacccctaacggtaaacctcccggtacccttaccggtaccggaccccggcccggaccggtaccgaccgggtttccgtttttaacgttttccgttggttcggaccgggtacgggtaccggtaaaggtccgtttcggggttaccttttacgaacgttacgtaacggggttcggggtacccgggttcggtacccgtacccgttcggtcccgtcgttccgttccttcccgtcgtaaccggtcctcccgtaaccggacccgggtccctacggtttcccccgg

SEQ ID NO: 363619 - DNA, 729 bp, Homo sapiens
  misc_feature: GZ8MTXP02FRCP4.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgtatctattcgttggggctggatccggcacgccccgagggagggatggagtggtagtggtagacatcctaagttacgtacgtcggggacgtaccgtactacgtcctcccgtccccctacgaacgtacgtccgttctacctaccgtacgtttaccggacggggtacctaccgtaccctaagttaccgtaaacccgttccgtttacctaccccgttagtaaaacccgttcgtaaaccccgttcccggtaccgaaccccggtcccggtaccgggtacccgtaccgggtttacccgtttttaatttccggtcggttcggaccgggtacggggacgtacggtacgtttcggttacctttttacgaaacgttcggttaacggtcgggggtcccgtacggtcccgtaacccgttgggtactacccgttcgtcccgttcctcgtaccgtacccttcccgaaccggaaccggtaccctacgtttcccccgg

SEQ ID NO: 363620 - DNA, 565 bp, Homo sapiens
  misc_feature: GZ8MTXP02FKT4F.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagctctcctgtgtagcgtctggattcaccttcaaacagacatggcatgcacgtggtccgccaggctccaggcaaggggactggagtgggtggcacgtttatatggtatgatggaaagtaataatattatgtagtattccgtagaagggccgattcaccatctcccagagaacaagttacgaaagtaacactactatatactaggaaaatgaaatagacctagaacgacgaccggaaggaccgaacgggctacgtacctaacgtaccttggtacgacgtaaggaagaggtcgggggacgttacggtagggaatacgaag

SEQ ID NO: 363621 - DNA, 612 bp, Homo sapiens
  misc_feature: GZ8MTXP02IMXTT.44.86.H09.1.454.CMB.2.raw
  modified_base (274)..(274): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggtccttcggggaaccctgtctctcatctgcactgtctctggtagtttccatctagttctgatctattcgttgggctggatccggnacgccccgagggacgggaagtggagtggagttggtgacatctaattagtacgtgggcacgtactactctccgtcccctacagcgtcgtctaccgactagtttcgaacggtactaccgtccaatcgtaaccgtcttcctccctagtaaactcgtaaccctccgtacgacccgtccggacggacctaccggttaccgtttactttgtcggttcgcggtagggccgaacgtcgtggttctttacgaattcgagttcggggcgtcggcctacccgtggtaacctcgttcgtccctccgtctacggtcttcccgaaccgtaaccgggtccctacgttccccgg

SEQ ID NO: 363622 - DNA, 617 bp, Homo sapiens
  misc_feature: GZ8MTXP02IKN73.44.86.H09.1.454.CMB.2.raw
  modified_base (277)..(277): a, c, t, g, unknown or other
  modified_base (281)..(281): a, c, t, g, unknown or other
  modified_base (304)..(304): a, c, t, g, unknown or other
  modified_base (581)..(581): a, c, t, g, unknown or other
  modified_base (593)..(593): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggagcgtggtccagcctgggagtcctgagctctcctgtgtagcgtctggattcaccttnaacngacatggcatgcacgtgggtccnccaggcctcccgagggcaaaggggacctggggacggtggggtgcctaagttatagtggtatgaatgggaaattaaataagtatttagtagttaagacgtttccggaggaaacgggtcccgtattaccgaccctaacgttctacccgaagaacgtaacgtaaaacgtttacgaaaacgaacaaacaaaccttaaatattaccgtaggaaaatagaaattacgaccgtgaaggacgaccggagaaccgacgggtactcggtactacgtacgttcgacgngaagaaggtagnggggtactggtaggtactacgaag

SEQ ID NO: 363623 - DNA, 785 bp, Homo sapiens
  misc_feature: GZ8MTXP02GV5QC.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggtccttcgggaacctgtctctcatctgcactgtctcgtggtacgtttccatctagttctgtatctagttcgttggggactggacgtccggcgaccgccccggaggggagggaagtgggaggtggtagttggagactactcctaattacgtacgggtcggggtactaacggttactaccgtccgtaccgtacccccgtacgtaacgtacgttcgtacctcctaaccgttacggtttaccgggaacgggggtaccctaccggttacccgaacgttaaccggtaaacccgttcccgtttacccttaaccccgttaaacggtaaacccgttacccggtaaaccccgtttcccgggtacccggaaccccgggtcccggaaccgggtaccccggtaccgggtttacccggtttttacgtttcggtcggtttacggacgggtacggggaccgtacggttaccgttgggtttcctttaacgacgtttacggtacgggtccgggggtccgtacggtacccgtaccggttcggtcctacggttccgttacctcccggtctaccggtccttacccgaaccgaccgggtaccctacgtttcccccgg

SEQ ID NO: 363624 - DNA, 590 bp, Homo sapiens
  misc_feature: GZ8MTXP02JC9M2.44.86.H09.1.454.CMB.2.raw
  modified_base (310)..(310): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtggagtcgtgggggaggcggtggtccagccgtgggaggtccctgagactctcctgtgtagcgtctggattcaccttcaacagacatggacatgccacgtgggtccncaggctccgaggcaagggctgggagtgggtgctacgttatagtggtatgagtaggaaagtaattaatattagtagtagtattcccggtaggacggggacctagttaccaacctagtactacccgaagacgtaaccaagttacgaaacgaaacacaacttatagtctaagggaatagaatacgacctagagacgaccggaagacgacggcgttagtacctaacgtacgtcgtacggacggaaggaagtaggtcgggggacttacggaggtacgtaacgaag

SEQ ID NO: 363625 - DNA, 709 bp, Homo sapiens
  misc_feature: GZ8MTXP02FP9XC.44.86.H09.1.454.CMB.2.raw
  modified_base (310)..(310): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccaggccgtgggaggtccctgagactctcctgtgtagcgtctggattccaccttcaacagacatggcatgctacgtgggtccnccaggcctccgaggcgaaaggggctggggaggttgggtcggactacgtttatagttggtataggaattaggggaaaacttaaattaagtagttagtagttaagtaagtttccgggaggaaacggggtcccgtaagttaccaaccctaattacccgtacccgaaaggacgtaaacccttaaagttaccggaaaaacgtaaccaaaccgtaaaccttaaacttaagttaccgttaaagggtaaaaattaggtaaaacttacggtacccgttaggaaacggaacgaccggggtaaagggaacccgaacgggtcttacggtacccttaaacgttaccgttgtaccggacggaaaggaaggtacggtcgggggtaccttacgggtacgggtaataaccgaaagg

SEQ ID NO: 363626 - DNA, 563 bp, Homo sapiens
  misc_feature: GZ8MTXP02JCWYQ.44.86.H09.1.454.CMB.2.raw
  modified_base (360)..(360): a, c, t, g, unknown or other
  modified_base (373)..(373): a, c, t, g, unknown or other
  modified_base (445)..(445): a, c, t, g, unknown or other
  modified_base (484)..(484): a, c, t, g, unknown or other
  modified_base (513)..(513): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgaggggacggggaagtggagtggagttggtgacatccattatacgtggggcgtacgtactactcctccgtccccctcaacgngtcgtctccactnttcgagggacacgtccatcgaacccgtcttcctccctagaaactcgaccctccgtcgacccgccgcggaccncggtccgtttagttctgtgcgaggcgagactggtacttnaatcgagtcgggctggccaccgtggtacncttcgtctcctcgtacgtccttaccgacgtaacggccctacgttccccgg

SEQ ID NO: 363627 - DNA, 717 bp, Homo sapiens
  misc_feature: GZ8MTXP02FISXI.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatcagttctgatcattcttggggctggatccggcagcccccgagggaggggaatggagtggagttggtgacatccattatacgtggggacgacgtactactccgttcctccccctacaagagtcgtctacacctattcgagggacgtacgtaccatcgtaaacccgtccttaccttacccctagaaaacctacgtacccgttaccccggtacgaccccggacccggcccgggtaccgtaacccgggttcccgttttaaacgtttccgttcgggttcggcggtaacggggaccgacggtaaccgttcggggttacgttttacctaaacgttcgttaacgggtcgggggtcccgggttcggggtaccccgaaaccccgtttcggggttccctaccgtttcggtccctttcccggtaacctaaccggtccctttaccccgaacccggttaaaacccgggggcccctaacggtttccccccgggg

SEQ ID NO: 363628 - DNA, 528 bp, Homo sapiens
  misc_feature: GZ8MTXP02FZ8TO.44.86.H09.1.454.CMB.2.raw
  modified_base (361)..(361): a, c, t, g, unknown or other
  modified_base (471)..(471): a, c, t, g, unknown or other
tcagacagtatatacacgaccggtgctcgatttagtgctatagacttgggtttgggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggcctttcgggaaccctgtctctcatctgcactgtctctggagtttccatcagttctgatcattcttggggctggatccggcagcccccagggaggggaatggagtggattggtgacatccattatactggggcgacgtacatctccgtccccctcaagagtcgtctcacctnttcgagggacacgtccatcgaaaccgcttctccctgaaactgaccctccgtcgaccgccgcgacacggtcctttattctgtgcgaggcgagactggtctttcaatctagnggggccgtggcaccctggtcactgctcctcagctccaccaacgggcccagttcccgg

SEQ ID NO: 363629 - DNA, 848 bp, Homo sapiens
  misc_feature: GZ8MTXP02IOXS1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttgggctggactccggcaccgcccccgaggggacggggaagtgggaggtggtagtttgggtacgactaacgtacctaagttaacttacgggttcgggggtaccgtaaccggttaaccttaccgtacccgttccccgttacccccctacgaaacgtacgtccggttactacccgtaaccttacgttttcgggaacgggtaccctaaccgttaccctaagtaccggtaaacccgtcctttaccctaccccgttaacgtaaaacctccgtaaaccccgttccggttacccggaaccccggcccgggaccgggtaacccgacccggggtttacccgtttttaacgttttccgtacgggtttcggaccgggtaacggggtacccggaacggttaaccggtttcggggttttacccttttaacgtaaacgtttaccggttaaggggttcccgggggttcccgttaacggggtcccgttaaaccccggttcggggttaaccttacccgttcggtttaccccttcccgttaaaccgcgtttaccccgtttaccccgaaaacccggtaacccgggtccccctaacggtttttcccccccgggg

SEQ ID NO: 363630 - DNA, 596 bp, Homo sapiens
  misc_feature: GZ8MTXP02GW3XO.44.86.H09.1.454.CMB.2.raw
  modified_base (361)..(361): a, c, t, g, unknown or other
  modified_base (373)..(373): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatctattcgttggggctggattcggcgacgcccccgaggggaggggaagtggaggtggagttggtgacgatcctaattatacgtgggcgacgtactactctccgtacccctcgaagngtcgtctcactntttcgaagggaccacgtccagtcgaaacccgtcttctaccctagaaacctcgaaccctccgtcgccgccgcgacgtaccggtcgtttattcgtgtgcggtaaggccgagtacgttggtctttacgtaattcgtaggtcggggtccgtcgggtcctacccggttggtcctacgtcgtcctcgttaacacgtcttacccacgaacgggtccctacgtttccccgg

SEQ ID NO: 363631 - DNA, 751 bp, Homo sapiens
  misc_feature: GZ8MTXP02I538Y.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggacgtggtgaggccttcgggaacctgtctctcatctgctactgtctcgtggtacgtttccatctagttctgtactctagttcgttgggtctggtacgtccggacgaccggcccccgaggggaacggggagtgggaggtggagtttggtagactagtacctagttacgtaacgtcggggacgtacggttaactaccgtcgttcccgtcccccgtacgaaacgtcgtaccgttcctaccgaccttacgtttccgggaacgggtacccaccgtccaacgtaccggtaaacccgtccttacccgtacccgtaacgtaaaccttccggaacccgttacccggtccggaccccggcccggtaccgggacccgtaaccggtttccgtttactttcggtcggttacgggaccggtagggtacccggagtaaccggttcggtttactttacgtagttaccgtagggtcgggtccgtacgggaccctccgggttcgtaccctaccgttcgttcccgttaccgtaaccgtacgtacccccgttacccggaaccggtaacccggtccctacggtttccccccggg

SEQ ID NO: 363632 - DNA, 571 bp, Homo sapiens
  misc_feature: GZ8MTXP02FINOF.44.86.H09.1.454.CMB.2.raw
  modified_base (384)..(384): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggccgtgggacggtccctgagctctcctgtgtagcgtctggattcaccttcaacagacatggcatgcacgtggtcccgccaggcctccgaggcgaaggggactgggaggtgggtggctacgtttatagtggtatggataggaaattaataatnttatgtaagatttccggagaacgggtccgtattacaccctatccgtccagagactaaatcgaaacgaacaacactaatatacgtaggaaaatgaaactagcctagacgagacccggaagaccacgggtcctggtactacgtactaggtcgacgtagaacgaggtcgggacctggtaggactactaag

SEQ ID NO: 363633 - DNA, 571 bp, Homo sapiens
  misc_feature: GZ8MTXP02F7SEN.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtatttccatcagttctgatcattcttggggctggatccggcacgcccccgagggagggaagtggagtggattggtgacatccattatacgtggggcgacgtactactctcccgtcccctcaagagtcgtctcacctnttcgagggtactaccgtacagtcgaacccgtcttcctccctgaaacttcgaccctcgtcgaccgccgcgacgacgtcctttattctgtgcgacggcgagtacttggtctttacgaattcgagttcggggccgtggccacccgttggtactacgtcgtcctcctccgacgccttacccacccgtaaacgggcccctaatttccccgg

SEQ ID NO: 363634 - DNA, 650 bp, Homo sapiens
  misc_feature: GZ8MTXP02FU1I1.44.86.H09.1.454.CMB.2.raw
  modified_base (376)..(376): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgacggccttcgggaaccctgtctctcatctgcactgtctctggtatttccatcagttctgatcattcgtggggctggatccggcacgccccgaggggacggggaagtggagtggagttggtgacatacctattagtacgtggggacgtaacgtactactctccgtcccctacaagacgtcgtctcactnttcgagggacacgtcatcgaaccgtcttctccctagaaactcgtaaccctccgtcggaacccgccgtacgggacaccggttacgtttacttcgtggttcgacgtagggacgacgtaccgttgggttacctttacgaaacttcgttaacgggtcgggggtacccggttacggtccctaaccccggttagggtcctaaccggttcggtcccttaccggtaacctacggtaccctttacccgaacccgttaaacggggccccctagtttcccccggg

SEQ ID NO: 363635 - DNA, 585 bp, Homo sapiens
  misc_feature: GZ8MTXP02FUOSX.44.86.H09.1.454.CMB.2.raw
  modified_base (300)..(300): a, c, t, g, unknown or other
  modified_base (445)..(445): a, c, t, g, unknown or other
  modified_base (470)..(470): a, c, t, g, unknown or other
  modified_base (576)..(576): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcgtggggctggatccggcacgccccgagggagggatggaggtgagttggngacgtatcctattatacgtggggcgtacgtactactctccgtcccctacagacgtcgtctacacctgttacggacggactacgtccatacgaacccgtcttcctccctagaaactcgtacccgttccgcgacccgcccgcggacnccgggttacctttattcgtagtcgngacggcgaacgcgttcggttctttacgaattcgtacggtcgggccgttcgggctcccgtaggtctacgtcgtccttccgaacacgtcctaccaccgacggtacccngtttccccg

SEQ ID NO: 363636 - DNA, 586 bp, Homo sapiens
  misc_feature: GZ8MTXP02IS3GC.44.86.H09.1.454.CMB.2.raw
  modified_base (305)..(305): a, c, t, g, unknown or other
  modified_base (417)..(417): a, c, t, g, unknown or other
  modified_base (423)..(423): a, c, t, g, unknown or other
  modified_base (520)..(520): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttcatctagttctgatcattcgttgggctggactccggcacgcccccgaggggagggaagtggagtggagttggngacatacctattagtcgtggggacgtacgtactacctctccgtcccctacgaacgtacgtcgtcctaccaacctgtttcggacgggacctacgtccatacgaaccgtcttcnccctanaaactcgaccctcgtcgaccgcgcgacacgtcgtttattcgtgtgcgagagacgtcgtggttcttacgaagttcgtaggtcggggtccgtggtaccncccggttggtcctacgttcgtcctccgtaacgcgttcctaccgacgtaacggccctacgttccccg

SEQ ID NO: 363637 - DNA, 620 bp, Homo sapiens
  misc_feature: GZ8MTXP02G2ZMU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttcatcagttctgatcattcgttggggctggactccgggctacgccccgagggacgggatggaggtggtagttggtgactatacctagttatacgtcggggacgtacgtacctactcctccgtccccctacgaacgtacgtccgtctaccacctacgtttcggacgggacctaccgtccaatcgaaacccgtcttccctaccctacgaaacctcgaacccttcgtacgacccgccggcgaccgacggttcctttattcgtgtcgcgaggcgtagacgttggtctttacgaattcgtagtcgggggtcctgggcctacccggtggtacctacgtcgttcctcctaacgtaccgtccttacccaccgaaccggtccctacggtttcccccgg

SEQ ID NO: 363638 - DNA, 755 bp, Homo sapiens
  misc_feature: GZ8MTXP02JFLMY.44.86.H09.1.454.CMB.2.raw
  modified_base (249)..(249): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcagcatctcctgcagttggggagcggctccaacgaggcggggcagattcngatcgtccactcggtaccaacaccttccgaaggaaccacggacccccaaactccctacacttactttacggtaaaccaacttacgtcccggacccttaccgaaccgggggttccccctaggtaccccgtacgtttcctccgtacgggtacccttacccgtaaagttccgtcgggtaccctacccgttccgtaaccggtcccccttacccccgtacggggtacccctaaacgttccccgtaaaccggtccgggggtcccttacccggaacggggtaccccttaaggggaaaaccgtaaggttccggggaaacgggggtttagttaaacttttaacggttaccgttacgggtaccccttaaacgggttccccttaaagtacgaacgacggtcaacggtccctacgtagttcggggttgggttacggttcgggacgggtacggaacacggtcgtacggacccgttcgtcgggtacccgaggaccccgacggtcccgtaccgtcccccgg

SEQ ID NO: 363639 - DNA, 679 bp, Homo sapiens
  misc_feature: GZ8MTXP02J1YPO.44.86.H09.1.454.CMB.2.raw
  modified_base (180)..(180): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagnggtgtccagtgtcaggtgaagctggtggagtcgtgggggagcgtggtccagcctgggacgtcctcgagacctctctgtgtacgcgtctggtattccaccttcaaacagacatggcagtcgctacgtcggggtcccgccgaggcctcccgagggcgaaagggtactggggaggtggggtcgactacgtttagtagtcgggtatggtaagtagggtaaattaaattaaagtactaaatcgacgagtaccttcgggaggaaacgggtccgtattacccaacctatccgtccgaaagaacgtaactaaacgttaccgaaaacgaaacccacgtactaggttactacgttacgaaactaaagtacggaaacctacggacctagggaacgaacgggtacccgaggggtaaccgacggggtactttgggtaacgttaagttacccgtagggtacggaaccgaaggtacctaagtttaagtttacggtaaccttaaccgtaaccccg

SEQ ID NO: 363640 - DNA, 682 bp, Homo sapiens
  misc_feature: GZ8MTXP02FXDW1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcagggagtcgggcccaggactggtgacggccttcgggaaccctgtctctcatctgcactgtctcgtggtactttccatctagttctgatctattcgttgggctggatccggcacgccccgagggagggatggagtggagttggtgacatcctattagtacgtggggccgtaacggtacctactcctccgtccccctacaacgacgtccgtctactacctgttccggaacggggacctaccgtcctagtcgaacccgtcttccctacccgtagtaaaacctcgtaacccttaccggaccgaccggcccggaccggtacccgtaccgggtttacccgtttttagttccgtacggttcggaccgggacgggtacgtacgtaccgttcgggttcttttaccgaaagttccgttacgggtcggggtaccgttcggccgtacccgtcgggttacaccgtttcgtccttaccctcgtaccgttaccttacccgaacccgttaaccggccccgttagtttcccccggg

SEQ ID NO: 363641 - DNA, 697 bp, Homo sapiens
  misc_feature: GZ8MTXP02GLDC9.44.86.H09.1.454.CMB.2.raw
  modified_base (304)..(304): a, c, t, g, unknown or other
  modified_base (310)..(310): a, c, t, g, unknown or other
  modified_base (316)..(316): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggaggtcgggcccaggactggtgaggtccttcgggaaccctgtctctcatctgctactgtctcgtggtactttccatctagttctgtatctattcgttggggctggatccggcgaccgccccgaggggacgggagtggnggtggngttggngactatctattatacggtggggactacgtactactcctccgtccccctacgaacgtacgtccgtactccacgtcgttcggacggtacctaccgtcctagtacgacccgtcttccgtaccctagaaactcgtaccctccggtcgacccggtacccgaccggtaccgtaccgggttccgtttacgttccgttacggttcggacgggtacgggacggtaacgtcgtttaccggggttctttaccgtaaagttccggtaagggttccgggggtcccgttcggacccggtaccccggtttacggtccctaccgtcggttcctcccgtcgttacccgtaccgtttacccgacccggtaaaccggtcccgttaaccggtttcccccgg

SEQ ID NO: 363642 - DNA, 660 bp, Homo sapiens
  misc_feature: GZ8MTXP02IOQOU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtgcagctccagatgggtcctgtcccaggtgcagctgcaggagtcgggcccaggacgtggtgaggccgttcgggaaccctgtctctcatctgcactgtctcgtggtactttccatctagttctgtatctagttcgttgggctggactccggcacgccccgaggggacgggagtgggagtggtagttggtagactactactagttagtacggtggggacgtacgtactacctccgtccgtcccctacgaacgtacgtcgtctacactcgttacggaacggacctaccgtaccacgtacgtaaccctcgttcctacccgtacgtaaactcgtaacccgtccgtacggaaccccgcccggaccggtaccgtaccggttaccgttttacgtttcgtcgggttcggaccgggtacgggtcgtaacgtcgttacggtttacttctaacgttcgtacggtcggggtccggtcgccgtaccgtggtcctacggttctcccgtctcgtacgtcccttaccgaccgaaccggtcctacgttccccgg

SEQ ID NO: 363643 - DNA, 630 bp, Homo sapiens
  misc_feature: GZ8MTXP02H4L8C.44.86.H09.1.454.CMB.2.raw
  modified_base (367)..(367): a, c, t, g, unknown or other
  modified_base (381)..(381): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagttccatcagttctgatctattcttggggctggatccggcacgcccccgaggggacggggaagtggagtggagtttgggtgacagttccattagtacgtggggacgacgtacgtacctcctccgtcccccctcgaagngtcgtctccacctntttcgagggacacgtccatgaacccgtcttcctcccgtacgaaacttcgaaccctccgtcgacccgtcccgacggaccacgggtccgttttaactttcgtcggtcgcggaggtcgacgtacgttggtctttacgaattctagtcgggggtcccgtgggtccctaacccggttcggtcctaccgtcgttcccttccgtccgacggtcctttacccgacccggtaacggggtcccctacgtttcccccggg

SEQ ID NO: 363644 - DNA, 512 bp, Homo sapiens
  misc_feature: GZ8MTXP02FG7KT.44.86.H09.1.454.CMB.2.raw
  modified_base (305)..(305): a, c, t, g, unknown or other
  modified_base (345)..(345): a, c, t, g, unknown or other
  modified_base (352)..(352): a, c, t, g, unknown or other
  modified_base (381)..(381): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttcaacagacatggcatgcactgggtccnccaggctccaggcaaggggactggagtgggtggcacttanatggtangatggaagtataatatatgtagattccgngaaggcgattcacatctccagagacaattcgaaagaacacaactatatctagaaatgaatagctgagagccgaggacacggctgtactactactgtacgcgagaagagtcggggctcggtggactacgaag

SEQ ID NO: 363645 - DNA, 882 bp, Homo sapiens
  misc_feature: GZ8MTXP02HXNWA.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgacggccttcgggaaccctgtctctcatctgcactgtctctggtacgtttccattctagttctagtattctatttcgttggggctggatccgggcaccggccccggaggggacgggtaagtgggaggtggtagttgggtacgacgtactacctagtttaacgtacggtcgggggtccgtaaccgttaccgtttaaccctccgttacccggtcccccccttacgtaaacggtacggtttcccgttaccgttaccctaacccgttacgtttttaccggggaaacgggggtaaccctacccgggttaccctaaacggttaccggtaaaaccccggttccctttacccgttacccccgttaaggtaaaacccgttcccggtaccccgttaccccgggttaccggacccccggtccccggacccggggtaaccgttaccccgggggttacccgttttttaaacgttttccggttacgggttcggtaccgggtacggggaccggttaacggtaaccgtttcggggttttaccgtttaactaaacgttccggttacggggttccgggggttcccggttacggggtcccgttaccccggttggggtttcccctaacgtttcccggtcccttacccgttcggtaacccgttcccttaccccggtaacccggaaacccgggggttcccctaaccggtttcccccggg

SEQ ID NO: 363646 - DNA, 674 bp, Homo sapiens
  misc_feature: GZ8MTXP02FH1U3.44.86.H09.1.454.CMB.2.raw
  modified_base (245)..(245): a, c, t, g, unknown or other
  modified_base (365)..(365): a, c, t, g, unknown or other
  modified_base (379)..(379): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcggaaccctgtctctcatctgcactgtctctggtatttccattcagtttcngatctattcgttggggctggactccggcacggcccccgagggacggggaatggagtggatggtgacatccatttactacgtggggcgacgttactactccgtccggtccccctcaaacgngtcgtctccacctntttcgaggtacacgtccatgaacccgtcttccaccctagaaaactcgtaaccctccgtacgacccgcccgccggaactccgggtcccgttttaatttccgtcgttcgcggaacgggcggtacgtaccgttacgggttcttttaccaaaagttccgttaaggtcggggggtccccgttaagggggccctaaaccccgtttcgggggtaccctaccgtttcggtccgttaacccttcgaaccggttccttacccccgaccgttaaaaccgggggaccccctacggtttcccccgggg

SEQ ID NO: 363647 - DNA, 554 bp, Homo sapiens
  misc_feature: GZ8MTXP02HOYP7.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccaggggacggggaatggagtggagttggtgacatccattatacgtggggcgacgtactactctccgtccccctcaagagtcgtctcacntttcgagggacacgtccagtcgaaccgtcttctccctgaaactcacctcgtgaccgccgcgacgacggtcctttattcgtgttgcgtaggcgagactggtctttcaatctagtcggggcctgggcacccgtggtacctctcgtcctccgtcacgtcctttaccaccgtaacgggccctagtttccccgg

SEQ ID NO: 363648 - DNA, 758 bp, Homo sapiens
  misc_feature: GZ8MTXP02JPP5V.44.86.H09.1.454.CMB.2.raw
  modified_base (307)..(307): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaccctgtctctcatctgcactgtctcgtggtagtttccatctagttctgtatctattcgttgggctggactccggcacgccccgagggagggatggagtggatggtganatctattatacgtgggcgtacgtactactccgtccgtaccccctacgtaagtacgtccgttcgtaccacctacgtttaccgggaagggtaccctaaccgttaccgaacgttaccggaacccgttcctttacccgtaccccttaagtaaacccgttcgtaccccgttaccggtaccggaccccggcccggtaccggaccgtacccgggttaccgttttacgtttccgtggtaccggtcggtacggggtacgtacggtaaccgttcgggtttacctttacgtaaacgtttccggttaacgggtcgggggtcccggttcgggacccttaacccccggttaggggttcccttaaccgtttcccggttcccttaaccccgttcgtaaccggttccccgtttaacccccgaacccggtaaaacccggggtcccccttaacggttttcccccccgggg

SEQ ID NO: 363649 - DNA, 695 bp, Homo sapiens
  misc_feature: GZ8MTXP02IPMLA.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggaggtcgtgggggaggcggtggtccagccgtgggaggtccctgagactctctgtgtagcgtctggattcaccttcaacagacatggcatgcagtcgggtcccgccacggcctccgaggacggaaggggacgtgggaggtggggtcggactacgtttagtagtgggttatgtaagttaggaaaagttaaattaagttaagtttaagtaggttagtacgtttaccggtaagggtaaaccgggtacctaatttcccgaaccctattccctaccgaagtaacgaaactaaagttaaccggaaaactaaaccaactaaacttaagttaacttacgtaaggtaaatagtaaagtacgtaccgtaggaaacggacggtaccggaaaggacccggtaacgggtccttacgggttacctaaacccgttagtacgggtacggacggaaggtaacggtagggtacgggggtcgttacgggtaggtaacgttaacgaagg

SEQ ID NO: 363650 - DNA, 633 bp, Homo sapiens
  misc_feature: GZ8MTXP02JTPOB.44.86.H09.1.454.CMB.2.raw
  modified_base (591)..(591): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgttccaggtgcagctgcaggagtcgggcccaggactggtgaggccttcgggaaccctgtctctcatctgcactgtctcgtggagtttccatctagttctgtatcattcgttggggctggatccggcacggcccccgagggacggggaatgggaggtggagttggtgacatccagttatacgtggggacgtacgtactactctccgccccctcagacgtcgtctcacctagtttccgagggtaccacgtccattacgaaacccgtcttacctcccgtagaaccttcgaaccctccgtacggaacccgtcccggacggtaccgacggttaccgtttagtttcgtacgtggcggtagggccgtaacgtcgttcggggttacctttgtaacgttcgtaagtcgggggtcccgtgggtcccaccggttgggacctccgtcgttccctcnctacggtccttacccaccggaaccggccctacgtttccccgg

SEQ ID NO: 363651 - DNA, 698 bp, Homo sapiens
  misc_feature: GZ8MTXP02GAH1U.44.86.H09.1.454.CMB.2.raw
  modified_base (245)..(245): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgcactgtctctggtatttcatctagttcngtatctattcgttggggctggacgtccggcacggcccccgaggggacggggaatgggaggtggtagttggtagactagtctaagttacgtacggtggggtaccgtaccgtactaccgtcctcccgtaccccctacaaggtacgtcgtctaccaccgttagtttaccggacgggtaccaccgtacctacgtaccgaaaccgtccttcctaccctagtaaacctcgtaacccgtcccgtaccgaccccggtaccgtaccgggaacctaccggggtttaccgtttaacttccgtcggtacggaccggacgggtaccgacgtacgttggtttccttacgtaacgtcgtacgggtcggggtccggttcggaccctaccccggttggtcctaccggttctcccgttccgtccgacgtacccttacccgaaccgtaccggtaccgtaccgtttcccccgg

SEQ ID NO: 363652 - DNA, 752 bp, Homo sapiens
  misc_feature: GZ8MTXP02GHOW7.44.86.H09.1.454.CMB.2.raw
  modified_base (360)..(360): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgctactgtctcgtggtacgtttccatctagttctgtatctattcgttggggtctggatccggcacgccccgagggacgggatggagtggtagttggtgacatcctagttatacgtggggcgtacgtactactctccgtcccctanaacgtagtcgtctaccactgttccgaggtactaccgtccgtacgtaccgtaccgtccttccctacccgtaacgtaccgtaccgtaaccccgttccgtcccgggtacccggcccgggtaacccggtacccgggtaacccggttttaccggttttaaccgtttccggttcgggttacggaccgggtacgggtaccggtaacggttaccgtttccgggtttaacctttaacgtacgtttaccggtacgggggttcccgggtaccgggtaccggtacccgttacccgggttcgttaaccccgtacgggttcccttccgttacccgtcggttacccgtacccgtttaccccgaaccgggtttaaaccccggacccgtttacccggttttccccccgg

SEQ ID NO: 363653 - DNA, 584 bp, Homo sapiens
  misc_feature: GZ8MTXP02FGK01.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgcccccgagggaggggaatggagtggattggtgacagtccattagtacgtggggcgacgtactactctccgtcccctcaagagtcgtctccactatttcggaggacaccgtcactgaaacccgcttcctccctagaaaactcgacccttccgcgacccgcccgcggaccacggtccctttattctggttgcgaagggcgagtacgtcggttctttcgaaatcgtagtcgggggccgttcgggaccaccccgtgggtcctacgttcggtcctcctcacggtccttacccacccgaacggcccacgtttccccgg

SEQ ID NO: 363654 - DNA, 565 bp, Homo sapiens
  misc_feature: GZ8MTXP02JPF1I.44.86.H09.1.454.CMB.2.raw
  modified_base (372)..(372): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatcattcgttggggctggatccggcacgcccccgaggggacggggaagtggagtggagttggtgacatccattatacgtggggcgacgtactactctccgtcccctcaagacgtcgtctcacctntttcgagggacacgtcatcgaacccgtcttcctccctagaaactcgaccctcgtcgaccgccgcgacgaccggtcgtttatttcgtgtgcgagggcgagtacgtggttcttacaattcgtagtcggggtccgtggcctaccgtgtcactcgtcctcctcgacgtccttaccaccgacggccctacgttcccgg

SEQ ID NO: 363655 - DNA, 563 bp, Homo sapiens
  misc_feature: GZ8MTXP02JJE4H.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagttttccattcagttctgatcattcttggggctggatccggcacgcccccgagggagggaatggagtggattggtgacatccattatacgtggggcgtacgtactactctccgtccccctcaagatcgtctcactntttcgaggacacgtcagtcgaaccgtcttctccctagaaactgaaccctcgtcgaccgccgcgacgacggtccgtttattccgtgtgcgtaggcgagacgtggtcttacaatctagcggggtccgtggccacccgtggtacctacgttcgtcctccgtcgaacgtccttacccgaccgacgggaccccagttccccgg

SEQ ID NO: 363656 - DNA, 606 bp, Homo sapiens
  misc_feature: GZ8MTXP02GL8ZD.44.86.H09.1.454.CMB.2.raw
  modified_base (184)..(184): a, c, t, g, unknown or other
  modified_base (309)..(309): a, c, t, g, unknown or other
  modified_base (356)..(356): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtntccagtgtcaggtgaagctggtggagtcgtgggggagcgtggtccagccgtgggacgtccctgagactctcctgtgtagcgtctggattcaccttcaaacagacatggcatgcacgtcgggtccnccaggcctaccgaggcgaaggggctggggaggtgggtgctactttanagtggtatgataggaaagttaataatattatgtagtacttcggagaacgggctattcaccatcctacaagacgaactaattacgaaagaacaactaactatactacgtagaaactagaaactaggacctaggaacggacgaccggtacgggaccgtaacgggcttacggttaccctaacgttaccgttaggtaccggacggaaggtaaggtacggtcgggggtaccttacgggtaggaacttaacgaagg

SEQ ID NO: 363657 - DNA, 679 bp, Homo sapiens
  misc_feature: GZ8MTXP02IRMXC.44.86.H09.1.454.CMB.2.raw
  modified_base (310)..(310): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctcgtggtacgttccatctagttctgatctattcgttggggctggactccggcaccgccccgaggggacggaagtggagtggagttggngacatactagttatacgtgggacgacgtactacgtcgttcccgtcccctacagacgtcgtctacacctgttcgaaggacctacgtacctataccgtaaccgtccttacctacccgtaagtaaaccgtccgtacccctaccggtccggaaccccgcccggacccgggtaccgacccgggtttcccgttttaacgttttccgtcgggtttacggaccggtacggggtaccggtaaacgttcggttcgggtttaccttttaaccggaaattccggtaaggggtccgggtccgtacgggcctacccgttgggtccacgttcgtacctccgtcgtacgtcccttaccgaaccgaccgggccctacggttccccg

SEQ ID NO: 363658 - DNA, 544 bp, Homo sapiens
  misc_feature: GZ8MTXP02JYJLV.44.86.H09.1.454.CMB.2.raw
  modified_base (305)..(305): a, c, t, g, unknown or other
  modified_base (347)..(347): a, c, t, g, unknown or other
  modified_base (372)..(372): a, c, t, g, unknown or other
  modified_base (445)..(445): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctctgtgtagcgtctggattcaccttcaaacagacatggcatgcactgggtccnccaggctccgaggcaagggctgggagtggggtgacacgttanatggtatgatgggaaattaataatnttaatgtagatttccggagacgggccgtattccgacctatcctcgagagaacaagttacgaaagaacacatanatctaggaaatgaatagctaggaagacgacgaagacacggtctgtactacgtacgtgtcgacggtagaagaggtcggggtctacggtggaactacgaag

SEQ ID NO: 363659 - DNA, 677 bp, Homo sapiens
  misc_feature: GZ8MTXP02JXZ5F.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtccgggcccaggactgggtgacggcccttcgggaaccctgtctctcatctgcactgtctcgtggtacgtttccatctagttctgatctattcgttgggtctggagtccggcacgcccccgaggggaggggtaactggaggtggagttggtagacatacctattatacgtggggacgtacgtactaccgtctccgtccccctacagtacgtcgtctcacctcttcggaaggacctacgtcctagtacgtaacccgtcttaccctccctacgtaaaccgtcgtacccgtcgttaccgacccgacccggaccggaccgtacccggttccgttttacgtttccgtcggttgcggtacgggtcgacggttaccgttcgtttctttaccgaagtttaccgtaggtccggggtaccgttacgggtaacccgttggtcctacgtcgttacccgtcccttacgaaccgttcccttacccgaccgtaaccggtccctaaccgttcccggtttcccccg

SEQ ID NO: 363660 - DNA, 766 bp, Homo sapiens
  misc_feature: GZ8MTXP02FZVT2.44.86.H09.1.454.CMB.2.raw
tcagacagtatatacacgaccggtgctcgatttagtgctatagacttgggtttgggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcactgtctctgggtactttccatctagttctgtatctatttcggtggggctggactccgggacacgccccgaggggacgggatggagtggagttgggtagacagtaccgtattaacgtacgggttggggtaccgtaacggttacttaaccgtccgttcccgtacccccgttacgaaacggtacgttccggtactacccgtaccgttacgtttcgaacggggtaacctaccgtacctaacgtacgtaacccgtccctttacctaccccgtaataaaaccgtcggtaaccctacccggtaccggtaacccggacccgtaccgggtaaccgacccgggtttaccgttttaaacttccggtaagttccggcgggtaacggggtaccggtaaacggttcgttacggggtttactttaaccgtaaacgtttccggtaaacggggtcgggggtaccggttcggacccgtaacccggttcggtacttaaccgtcggtcccttaccgtaacgtaccgtccgttaccccaaccgtaaccgggccctacggtttcccccgg

SEQ ID NO: 363661 - DNA, 736 bp, Homo sapiens
  misc_feature: GZ8MTXP02IXV4H.44.86.H09.1.454.CMB.2.raw
  modified_base (304)..(304): a, c, t, g, unknown or other
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgcccccagggaggggaactgggagtggattggngacatccattatacgtggggcacgtactactctccgtcccctcaagacgtcgtctcaccntttcgagggaccacgtccatcgaaccgcttctacccgtagaaaacgtcgacccgtcccgtacggacccgtcccggaccggaccaacggggttcccgtttaaacgtttttccgtagggtttcgaccgggtacgggggacccgtaaacgggtaccgtttcgggggttacctttttacctaaaacgtttcccgtttaaaagggtccggggggttaccccgttacggggttccccggtaaccccggtttcgggggttaaacccttacccgtttcgggttaccccctttaccccggttcccttaaaccgggtacccctttttaccccgaaccccggaaaaccgggggtcccccctttaacgttttcccccccggggg

SEQ ID NO: 363662 - DNA, 611 bp, Homo sapiens
  misc_feature: GZ8MTXP02IXQ2K.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaacctgtctctcatctgcactgtctctggtagtttccatctagttctgactcattcgttggggctggactccggcacgccccgagggaggggatggagtggagttggtgacatctattatacgtggggactacgtagttactctccgtcccctacagtacgtcgtctccacctgtttcggaggaccacgtccagtacgaaaccgtcttctccctagaaactcgtaccctacgtccgaccgtcccggacggacctacggttccgttttactttcgtacggttcgaccggtacgggcgaacggtcgttcgggttctttaacgtaattccgttagtccgggggtccgttcgggccctaccgtcggtctcgtcgtcctctcgacgttcctaccgaacgaccgccgacgtttcccgg

SEQ ID NO: 363663 - DNA, 671 bp, Homo sapiens
  misc_feature: GZ8MTXP02JOH84.44.86.H09.1.454.CMB.2.raw
  modified_base (168)..(168): a, c, t, g, unknown or other
  modified_base (324)..(324): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggngtcgggcccaggactggtgacggtccgttacgggacctgtcctctctatctcgcctacgttgtcctcgtggttaacgtttccatcgtagttctagtactcgtagttcggtgggctggtacgtccggcaccggccccggtaaggggagggagtaggngtggtagttgggacactatcgtagttacgacggtcggggtactacggttactacctccgtccgtacccctacgtaagtcgtccgtctaccacgttacgttacgggacggtactacccgactacgtaccgaacccgttccttaccgtaccctaacgtaacctcgtaacccgtcgtccgaccgccggacgtaccgtacggttcctttgtctcgggtacgcgggtcggacgtacgtcggttcggttacttacgaattcgggtagggtccgggtccgttacgaccgtccggttcgactcggtcctctccgtgaccgttaccacccgacggaccgtcccttcggttcccccg

SEQ ID NO: 363664 - DNA, 665 bp, Homo sapiens
  misc_feature: GZ8MTXP02G9C8Z.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctcgtggtacgtttccatcagttctgtatctattcgttgggctggactccggcacgtccccgaggggagggaagtggaggtggagttggtgacatcctattatacgtggggacgtacgtactactcctccgtcccctacgaagngtccgtactccactacgtttcggacggggtacctacgcctacgtacgaacccgtacttccgttaccctacgtaaacctcggtaccctcccggttacggccccggacccgaccgggtacgtcccgggttaccgttttaacgtttctcggtcggtccggtacgggtacgacgttacgtacggttctttacgaagttcgtacggtcggggtccgtcggacccgtaccgtcggtactccgtccgtccttaccggtcctacgtcccgttacccaaccggtaaccggtccctacgtttcccccggg

SEQ ID NO: 363665 - DNA, 759 bp, Homo sapiens
  misc_feature: GZ8MTXP02IGBHU.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctccagatgggtcctgtcccaggtgcagctgcaggagtcgggcccaggactggtgaggccttcgggaaccctgtctctcatctgcactgtctcgtggtacgtttccatctagtttctaggtacttctattcgttggggtacgtcgggacgtcccgggcaccggacccccggtaggggaacggggaagtaggggaaggtgggtaagtttgggacgtaaccgtagtaccctaagttaacgttacgggtacggggtacgtaaccgttaacttaccgttccgtaccgttacccccctacgtaaacggtcgttaccgttcctaccgtaaccttacgtttacggaacgggtacctaccgtacctacgtaccgaacccgtactttcccaccctacgaacctacgtacccgttcggtacgacccgtcccggccggtaaccgtccggttaccgttttagtttccgtggttacgcggtaacgggcgtacgtacgttcggtttcgtttacaagttcgtacggttaccggggccgttacggtcccgtaaccgttcgggtacctacggttccgttacctccgttaacgtaccgttacccttacccggaaccgtaacccggtcccttaacggtttcccccggg

SEQ ID NO: 363666 - DNA, 594 bp, Homo sapiens
  misc_feature: GZ8MTXP02JDZSD.44.86.H09.1.454.CMB.2.raw
  modified_base (518)..(518): a, c, t, g, unknown or other
  modified_base (549)..(549): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctcgtggtagtttccattcagttctgatctattcgttggggctggactccggcacgccccgagggagggaatggagtggagttggtagacagtcaattacgtacgtggggctaacgtactacctctacccgtcccctacaagactcgtctccacctagtttcggaacgggacctaacgtcccaagttacgaaacccgtctttaccgacccttagaaactcggaacccttcgacgacccgcgacgacctacggtccgtttattcgtgtcgtacggagcgagtacttggtcctttanagttatacggtgggccgtgcacccgtgtccncttcgctccgtcacgtccttaccaccgaacggtccacgtttcccg

SEQ ID NO: 363667 - DNA, 749 bp, Homo sapiens
  misc_feature: GZ8MTXP02JTCPX.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgttggggcttgggacgtccggcacggcccccgaaggggacggggagtgggaggtggtagttggtgacatccgtaattagtacgtggggacgtacgtaccgtacctcctcccgtccccctacgaacgtacgttccgtccttaccaacctgtttaccggaagggtacctaccgtaccacgtaccgtaacccgtcctttacccgtaccctacgaaacctcgtaccccgttccggtacccggaccccgccggacccgggtaccgtaacccgggttcccgtttttaactttccggttcgggtcggtacgggtacgggaccggtacggtaacccgttcggtttaccgtttactaaacgtttaccgtacggggttcgggggtacccggtcgggtcccgtacccgggtacggttccctaccggttcgttccccgttaccctcgtaccggttcccttacccgaaccccggttaaaccgggccccgttaacgtttcccccggg

SEQ ID NO: 363668 - DNA, 727 bp, Homo sapiens
  misc_feature: GZ8MTXP02IF3S4.44.86.H09.1.454.CMB.2.raw
  modified_base (358)..(358): a, c, t, g, unknown or other
  modified_base (426)..(426): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcggggaaccctgtctctcatctgcacttgtctctggatttccatctagttctgatcattcgttggggctggatccggcacgcccccgaggggaggggaatggagtggagttggtgacatccaagttaatacgtggggacgacgttactactctccgtccccctanaaagtcgtcgtacctccacctagtttccggaagggacctaaccgttccagtacggaaaccctcttacncccctaggaaacctcgaaccctccgtacgacccgccgaccgggacgtaccgggtacccggtttttatttccggtcgttacgggcggtaacgggccgtaacggtaacgttcgggttaccttttacgaaactttccgttaaacgggttccgggggtcccgtttaagggcccccgtaaaccccggtttacggggttccctaaaccgtttccgggttccctttaaacccccggtaacgttaacccggttacccgttaaccccgtaaacccggtaaacccggggtacccctaaccggtttccccgg

SEQ ID NO: 363669 - DNA, 615 bp, Homo sapiens
  misc_feature: GZ8MTXP02H4OGT.44.86.H09.1.454.CMB.2.raw
  modified_base (304)..(304): a, c, t, g, unknown or other
  modified_base (316)..(316): a, c, t, g, unknown or other
  modified_base (349)..(349): a, c, t, g, unknown or other
  modified_base (370)..(370): a, c, t, g, unknown or other
  modified_base (517)..(517): a, c, t, g, unknown or other
tcagacagtatatacacgaccggtgctcgatttagtgctatagacttgggtttggggatgctttctgagagtcgaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctctggattccatcagttctgatcattcgttggggctggactccggcacgccccgaggggacgggaatggaggtggagttggnactatccattanacgtggggctacgtactactctccgtcccctanaagacgtccgttctacacccngtttaccgagggtaccacgtccatcgaaccctcttaccgtcctagaaacctcgacccttccggtacgacccggccgaccgggaccaccggtaccttacgttttacttcgtcgttacggcgacgggcgacgtactttcggtactttanacgttcgtaaggtcgggggtcgttacgccgtaaccgttcggtacctacgttcgtcctaaccgtcgaacgtcccttaccgaccgtaacggtccctacgg

SEQ ID NO: 363670 - DNA, 638 bp, Homo sapiens
  misc_feature: GZ8MTXP02GNMGV.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgatctattcgttgggctggactccggcacgccccgaggggagggaagtggagtggagttggtgacatcctattacgtacggtggggacgtacgttacctactccgtccgtccccctacgaacgtagtccgtcctactacctcgttacggacgggtacctaccgtacctagtacgaacccgtcttccctaccctagaaactcgaacccgtcgtaccgacccgtccgaccggaccgaccggttccgttttacgttcgtcggtcgcggagggtccgaacgtacgttaggttctttaacgaagttcgtaggttcgggccgtcggcctaccggtcggtctacgtcgttcctcctcgtaccgtcttacccgaaccgtacggtcccacgtttccccgg

SEQ ID NO: 363671 - DNA, 694 bp, Homo sapiens
  misc_feature: GZ8MTXP02JES10.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctctggtacttccatctagttctgtatctattcgttgggctggacgtccggcacggccccgaggggacgggaagtggagtggagttggtagacatactagttacgtacggtcgggacgtacgtactactcgtccgtacccctacaagtcgtcgtctactactgttacgacggtacctaccgtcagtaccgaaccgtcttaccctacccgtacgaaactcgtacccgtaccgtccggaacccgtcccggaccggtaccgtaccgggtttaccgtttacgtttacgtcggtcggtacgggacgggtaccggtaagttacggttcggtttactttacgtaacgtttacgtacgggtccgggggttccgtacgggtcccgaacccggttcggtacctaccgttccggttcccttacccgtaacgtaccggtacccttacccgaacccggtaaccggtcccgtaacgtttcccccggg

SEQ ID NO: 363672 - DNA, 601 bp, Homo sapiens
  misc_feature: GZ8MTXP02FMB14.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatcagttctgatctattcttggggctggatccggcacgccccgagggacgggaatggagtggtagttggtgacatcctattatacgtggggcgtacgtactacgtctccgtcccctacacgtagtccgtctaccacctgtttcgacggtacaccgtccgatcgaaacccgtcttcctaccctagaaacctcgacccttccgtacgacccgtccgacggtacaccggtccgtttaacttcgtgtgcggaggcgtacgtacgtggtctttacagttctagtcggggtccgtcggccaccgtggtacctacgttcgtccttccgtctacggtcccttaccgaccgtaacgggccctacgtttccccgg

SEQ ID NO: 363673 - DNA, 574 bp, Homo sapiens
  misc_feature: GZ8MTXP02FHJ6T.44.86.H09.1.454.CMB.2.raw
  modified_base (332)..(332): a, c, t, g, unknown or other
  modified_base (450)..(450): a, c, t, g, unknown or other
  modified_base (465)..(465): a, c, t, g, unknown or other
  modified_base (467)..(467): a, c, t, g, unknown or other
  modified_base (471)..(471): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgtatctattcgttgggctggatccggcacgcccccgaggggacggggaagtggaggtggagttggtagacatacctattagtacggnggggcgtacgtactactcctccgtccccctacgaacgcgtcgtctccactcttcggacggacacgtcatcgaaccctcttcctccctagaaactcgaccctccgcgaccgccgcgacncggtctttatctcgngngagngacgtacgtggttcttcatctaggtcgggaccgtcggcctacccgtggtactacgtcgtcctcctcgcgtccttacccgaccgtaacggccccagttccccgg

SEQ ID NO: 363674 - DNA, 650 bp, Homo sapiens
  misc_feature: GZ8MTXP02FIG2Z.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcatgtctctggtagtttccatcagtttctgatctattcgttggggctggatccgggcacgccccgagggaggggaagtggagtggtagttggtgactagtcctaatttagacgtaggggcgtaaccggttactacctccgttcccggtccccctacgaaacgcgttccggtctccgacctagtttccggaacgggactacgtccagtcgaaccgtcctttctacccctaggaaacctcgaacccttccgacgacccggccgcggaccgaccggttccgtttactttcgtgtcgcgaacgggtcgaacggtcgttcggttcttttacgaacgttcgtaaggtcgggggccgttcggccgtacccgtggttctaccgtcgtcctacctcgacgtccttacccgaccggtaacgggtcccccgtcggtttcccccg

SEQ ID NO: 363675 - DNA, 613 bp, Homo sapiens
  misc_feature: GZ8MTXP02GZXI4.44.86.H09.1.454.CMB.2.raw
  modified_base (308)..(308): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaccctgtctctcatctgcactgtctctggtagtttccatctagttctgatctagttcgtgggctggactccggcacgccccgaggggaggagtggagtggagttgggtnacgactacctagttacgtacggtggggacgtacgtacctactccgttcccgtaccccctagaaacgtcgtccgtctccacctgtttaccgagggaccaccgtccacgtacgaacccgtcttcctacccgtagaaacctcgtaccctcggccgacccgccgacggactacggtcctttattccgagtgacgtggccagtaccgttggttctttacgaattcgtaggtcggggtcccgtggcctcccgtggtactcgtctcctacgtcgtcgtccttacccgaccgtacggtccctcggtttcccgg

SEQ ID NO: 363676 - DNA, 582 bp, Homo sapiens
  misc_feature: GZ8MTXP02HPONP.44.86.H09.1.454.CMB.2.raw
  modified_base (457)..(457): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcgttggggctggatccggcacgccccgagggacgggaatggagtggagttggtgacatcctattagtacgtggggcgtacgtactactcgtccgtcccctacagacgtcgtctccactgttcgaggtacacgttccagtcgaacccgtcttcctccctagaaactcgaccctcgacgaccgccgcgacacggtccgtttattcgngttcgcgaggcgagcgtggttacttcaattcgtaggtcggggcctcggccgtacccgtggtaccacgtcgtccctccgtaactacggtcccttacccaaccgaaccgggtccctacgttccccgg

SEQ ID NO: 363677 - DNA, 736 bp, Homo sapiens
  misc_feature: GZ8MTXP02JIX56.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggccttcgggaaccctgtctctcatctgctactgtctctggtacgtttccatctagttctgtactctattcgttggggctggacgtccgggcaccggcccccggaggggacggggtagtgggaggtggtagttggtgacatcctaagttacgtacggtggggtacgtacgtactacctccgtccgtcccctactaacgtacgtccgtctactacctgtttccggacggtacctaccgtaccagtacgtaacccgtccttcccgtaccctaacgtaaccttcgaaccccgttccggtaccgaacccggtcccggaccgggtaaccgttacccgggttacccgttttaacgtttccggtcgggttcggtaccgggtacgggtaccgtaacggttaccggttcgggtttacctttacgtaaacgttccgttagggtccgggggtcccggttacgggtcccgtaacccggttcggtacctccgttcgttcctccgtaacgtaccgtacccgttacccgaccgtaacccggtcccgttaacgtttcccccgg

SEQ ID NO: 363678 - DNA, 690 bp, Homo sapiens
  misc_feature: GZ8MTXP02I2MZ4.44.86.H09.1.454.CMB.2.raw
  modified_base (283)..(283): a, c, t, g, unknown or other
  modified_base (299)..(299): a, c, t, g, unknown or other
  modified_base (312)..(312): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgcacttgtctcgtggtacgtttccattctagttctagtatctatttcgttggggctggactccggcncgccccgagggagganggagtgagttggnacatcattagtacgtgggcgtacgtactactactcctccccgtacagtacgtacgtctccacctacgttcgtacggacgaccgtcacgtacgtacccgtaccttccgtaccctaccgtaaacgtaccgtaccctacccgttccgacccgtacccggtacccgggacccgtaccggttacccgggtttaacgttttccgttacggtttcggaccgggtacgggtaaccggtaccggtaacggttcggtttacggtttacttaaccgttacgtaacgggttcgggggtcggtaccggtccggtaaccgtacgggttcgtacctccggtcttcctcgtacgtccgttacccgaaccgtaccggaaccgtaccgtttcccgg

SEQ ID NO: 363679 - DNA, 654 bp, Homo sapiens
  misc_feature: GZ8MTXP02IQ3ZW.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgtttccatctagttctgatctattcgttggggctggactccggcgacgcccccgaggggaggggaagtggaggtggagttggtgacatcctattagtacgtgggacgacgtactacctctcccgtcccctacgaacgcgtccgtctaccactcgtttcgaagggaccacgtccagtcgaaccgtccttcctaccctacgaactcgaacccttccgtacggacccgcccggacgaccgtaccggtaccgttttactttcgtcggttcgacggtacgggtacgacggtacgttcgggtttactttacgaagtacgttacgtcgggggtaccggttacggacccgttaacccgttggttacctacgttcgttcccgtcctaacgacgtccttacccgaaccgtaacgggccctacgtttcccccgg

SEQ ID NO: 363680 - DNA, 684 bp, Homo sapiens
  misc_feature: GZ8MTXP02FJVFB.44.86.H09.1.454.CMB.2.raw
tcagacagtatatacacgaccggtgctcgatttagtgctatagacttgggtttggagatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagttccatctagttctgatctattcgtgggctggactccggcacgccccgaggggagggagtggtagtggtagttggtgactactcctagttagtacgtggggacgtacgtactactcctcccccgtccctacgaagtcgttcgtcctactcctacgttcggacggacctacgtccacgtacgtaacccgtcttccctaccctagtaaacctcgtaccctccggtacgaccccggccgacggtaccgtaccgggttcctttacgtttcggtaggtccggtcgggacgggtaccgtacggtacgtttggtttccgtttaacgtaacgtttaccggtaacggttccgggggtccgttcggggtacccttacccggtcggttaccgtaccgttccgttccctcccgtactacccgtcccgttacccgaaaccggtaacccgggcccctttacccggg

SEQ ID NO: 363681 - DNA, 757 bp, Homo sapiens
  misc_feature: GZ8MTXP02IDGK3.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcggggaaccctgtctctcatctgcactgtctctggagtttccatctagttctgatctattcttggggctggatccggcacgccccgaggggagggaagtggagtggagttggtgacactctaagttatacgtggggacgtacgtactactctccgtcccctcaaagtcgtcgtctaccaccttacgtttacggaacgggtacctaccgtccctaacgtacggaaacccttccttacctacccgtacgaaaaccgtcgtaaccccgttccggttccgaacccggtacccggaccgggtacccgtaccgggttacccgtttttaacgttttcccgtagggtttacggcgggtacggggtaccgtacgggtaaccgtttgggtttacctttaccggtaaaacttcggttaacgggttcccggggggtaccggttacgggggtccccttaaccccgggttcgggttaacccctacgttaccggtttccctaccggtcccttaacggtccccctttacccgaaaacccgggtacccgggggtaccccttaacggttttccccccggg

SEQ ID NO: 363682 - DNA, 591 bp, Homo sapiens
  misc_feature: GZ8MTXP02JZ7AN.44.86.H09.1.454.CMB.2.raw
  modified_base (453)..(453): a, c, t, g, unknown or other
  modified_base (469)..(469): a, c, t, g, unknown or other
  modified_base (497)..(497): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtagtttccatcagttctgatctatttcgttggggctggacgtccggcacggcccccgaggggacggggaatgggagtggagttggtgactataccattatacgtggggcgtacgtaacctactccgtccgtccccctcaagtacgtcgtctcacctgttcgagggacacgtccatcgaacctcttacctcctacgtaactcgacctcgtccgccgccgcggacncgttcctttagttcgngtgcggaggcgagtcgttacggttcttnaactcgtacggtcgggtccgtggcctaccgtggtacctcgtcgtccttccgtcgtacgtccttacccgaccgaccggtccctacggttccccgg

SEQ ID NO: 363683 - DNA, 602 bp, Homo sapiens
  misc_feature: GZ8MTXP02GU1XP.44.86.H09.1.454.CMB.2.raw
  modified_base (365)..(365): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtagtttccatcagttctgatcattcttggggctggatccggcacgcccccgagggagggatggaggtggagttggtgacatccattatacgtggggcgacgtactactctccgtcccctcaagcgtacgtctcacntttcgagggactacgtcatcgaaccgcttctaccctgaaactcgaccctccgtcgacccgccgcggaccaccggtacctttacttcgtgtgcgtagggccgtagacgtggttctttacgaattcgtaagttcgggggccgttcggcctaacccgttgggtacctacgttcggttcccttccgtcgtaccggtcctttacccgaaccgtaaaccggggccccctaagtttcccccggg

SEQ ID NO: 363684 - DNA, 709 bp, Homo sapiens
  misc_feature: GZ8MTXP02JXNE1.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggacgtccgggcccaggactggtgaggccttcgggaaccctgtctctcatctgcactgtctcgtggtacgtttccatctagtttctgtattctacgtttcgttggggcttggacgtccgggccacgcccccgaggggaggggaatgggagtggagttggtgactatcctaagttagtacgtggggctaacgttaacctacctccgtccgtcccccctacgtaacgtacgtccgttactccactacgtttccggaacggtacctaccgtacctagtacgaacccgtcctttacctaccctacgtaaactcgtaacccgttcccggtacgacccgtcccgggaccggtaccgtacccgggttaccgttttattccgtcggtcggaccgggtaggggtacgtaacggtccgtttcgggtttaccttcctaaacgtttccgttaagggtccgggggtccgtcggacccgtacccgttggtcctacgtcgttccctaccgtcgaccgtccttaccccgaccggtaaccggtccctacggtttcccccgg

SEQ ID NO: 363685 - DNA, 530 bp, Homo sapiens
  misc_feature: GZ8MTXP02FK12W.44.86.H09.1.454.CMB.2.raw
  modified_base (279)..(279): a, c, t, g, unknown or other
  modified_base (284)..(284): a, c, t, g, unknown or other
  modified_base (353)..(353): a, c, t, g, unknown or other
  modified_base (383)..(383): a, c, t, g, unknown or other
tcagacagtatatacacgaccggtgctcgatttagtgctatagacttgggttgggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtggagtctgggggagcgtggtccagcctgggaggtccctgagactctcctgtgtagcgtctggattcacccttnaaacngacatggcatgcacgtgggtccgccaggctccagggcaaaggggactgggagttggggtggcactttanatgggtaatggatgggaataataatattangttagattccgtgaaagggcccgatttcaccatcgtccatagacaaattcgaaagaacacactatatctaggaaatgaatagcctagagagccgagacacggctgtctactactgtcgcgagaagtagtggggctcgtggatataag

SEQ ID NO: 363686 - DNA, 682 bp, Homo sapiens
  misc_feature: GZ8MTXP02JGURW.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaacctgtctctcatctgcactgtctctggtagtttccatcagttctgatctattcgttgggctggatccggcacgccccgagggagggaagtggaggtggagttggtagacgatccgtaattacgtaacggtcggggacgtaccgtaactaccgtccttccgtcccccgtacgtaacgtacgtccgtactacctaacctcgtttacggacggtaaccgtaccgtcctaacgtacgtaaacccgtccttacccttaccccgtagaaaaccctcggtaaccccgtccgtaccgaccccggacccgccgggaccgtaccgggttaccgttttatttccgtgggttacgcggacgggacgtaacggtcgttcggttactttacgaacgttcgtaggtccgggggccttcgggccgtaccccgtggtacctccgttcggtcctaccgtcgtacgtccttacccgacgaccgggtcccacggttccccgg

SEQ ID NO: 363687 - DNA, 747 bp, Homo sapiens
  misc_feature: GZ8MTXP02F9RUH.44.86.H09.1.454.CMB.2.raw
  modified_base (193)..(193): a, c, t, g, unknown or other
  modified_base (222)..(222): a, c, t, g, unknown or other
  modified_base (234)..(234): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccactctgtgctgacgcagcccgccctcagtgtcgtcggggccccgggnaggaggtcaccatctcctgcacgtgggancagactccaacngtcgggacagtattctgatcgtccacgtcggtaacccaaccgtacccttaccgaacggaaccaccgaccccccctaaactccctactacgtttcgtttaacggaaaacctaacttacgtcccgggtaccccttaccggtaaccggggttcccctacggtaaccccggttactttccccgttaccgtaccgggtacccttacccgtaaacggttcccgtacgggtcccctacccgttaccgaccgttccccccgttaccccgttcgggacccctaacgtcccgtaccggtccggaccctaccggacggtacgtacgaacggtagtagggtaggtagttaactttacgttacgtaccgtacgtaccgtacgtagtacgacgacgcgtacgtccgtgtacgggttgggttcgggttcggtacgggacgggacggaaccgtacggtaccgtaccggtacccgtacggtccggtacgacccggtaccggtaccgtcccgtccccggtacccgtcccgg

SEQ ID NO: 363688 - DNA, 761 bp, Homo sapiens
  misc_feature: GZ8MTXP02G5H6V.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggattcgggcccaggactggtgaggccttcgggaaccctgtctctcatctgcactgtctctggtatttccattcagttctgatctattcgtggggctggatccgggcacgcccccggaggggacgggagtggaggtggtagtggtacgatatacctatacgtacggtcgggacgtaacgtactacctcctacccgtcccctacgagtacgtccgtctacctaccttgttccgggaacggtaccgtaccgtacctacgtaccgaccttaccgttaccctccgtaacgtaacgtcgaacccgtccgtacccgaccgcccgggaccggtaaccgtacccggtttaccggtttactttccggttacggtacggtacgggaccggggtacggtaaaccggttacgtttaccgggtttcctttaacgtaaacgtttcgttaacgggggttccggggtacccggtccggggtaccccgtaacccggttcgggttaaaccccttacgttccggttacccttaccccgtccgttaacccggttcccgtttaacccccgaaacccgggtaacccggggttaacccctacgggtttaccccccgggg

SEQ ID NO: 363689 - DNA, 654 bp, Homo sapiens
  misc_feature: GZ8MTXP02I27RR.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttggggctggacgtccggcacggcccccgaggggacgggaagtggagtggtagttggtagacatacctattagtacgtgggactacgtactacctccgtcccgtaccccctacgtaaagtacgtccgttctaccaacctgtttaccggaagggacctaacgtccaatacgaaacccgtccttcctcccgtaagaactcgaccctccgtacgacccgccgccggacgtaccggttaccgtttattcgtacgtgacggtagggcgtacggtacttcggtctttaacgtaactcgttagggtcgggtccgtcggtaccgtacccgtgggtacctacgttcttaccgtcctaactacgtcccgttacccgaccgtaaacgggtacccctacgtttcccccggg

SEQ ID NO: 363690 - DNA, 607 bp, Homo sapiens
  misc_feature: GZ8MTXP02G4GVI.44.86.H09.1.454.CMB.2.raw
  modified_base (480)..(480): a, c, t, g, unknown or other
  modified_base (563)..(563): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtactttccatcagttctgatctattcgttgggctggatccggcacgccccgagggacgggatggagtggagttggtgacatccagttatacgtgggcgacgtactactctccgtcccctacgaagtcgtcgtctacaccgtctttacgacgggtacaccgtccacgtacgaaacccgtcttcctacccgtagaaaccctcgacccgttacgccgacccgccgtacggaccctacggtaccgtttatttccgnggttcgcggagggcagtacgttgtcttacgatcgtaaggtcggggtcctggtcctacccgtgggtacctcgttcgcccttccncgtacgcccttaccgaccgtaacgggccctaacgtttcccccgg

SEQ ID NO: 363691 - DNA, 724 bp, Homo sapiens
  misc_feature: GZ8MTXP02HSR8G.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgacggccgttcgggaaccctgtctctcatctgctactgtctcgtggtagttccatctagttctgattctattcgtgggtctggactccggcacgccccgagggacgggagtggagtggtagttggtagacgtatcctaagttacgtacggtcggggtacgtaacgtactactccgtcccgtcccctacgaacgtacgtcgtctaccacttcgttacggacggtacctaccgtaccagtaccgtaacccgtcctttaccctaccgttaacgaaacccgttcgtaacccccgtttccggtaacccggaccccggacccggaccgggtacccgtaccgggttacccgttttacgtttcgtacggttcggacggtacgggtccgtaacgtacgtttcggtttactttacgtaaacgttccgttacggtccgggggtaccgtacggtcccgttaacccgtggtaccgtacgttccgttccgtcctaacgtaccgtacccgttacccgaaacccggtaaccggtacccttacggttcccccgg

SEQ ID NO: 363692 - DNA, 634 bp, Homo sapiens
  misc_feature: GZ8MTXP02FL24N.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcagggagtcgggcccaggactggtgacggccttcgggaaccctgtctctcatctgcactgtctctggtatttccatcagttctgatctattcttgggactggatccggcacgcccccgaggggaggggaagtggagtggagttcgggtagacaatcctaagttaatacgtgggggtacgtacgttacctacttcctccggtcccccctacaagtacgttccgtactccaacctgtttcggaagggtaccacgtaccatacgaacccgtccttcctaccccgttagaaaactcgaccctcccgtacggacccgcccggtacggaccgtccggtaccgtttacttcgtgtggcggtaggcgtagtacgtggttctttcaattcgtagtcggggtccgtggcctaccgtggtcctacttcgtccttccgtcgacgtcccttaccgacccggtaacggcccctagtttccccgg

SEQ ID NO: 363693 - DNA, 610 bp, Homo sapiens
  misc_feature: GZ8MTXP02F7O02.44.86.H09.1.454.CMB.2.raw
  modified_base (360)..(360): a, c, t, g, unknown or other
  modified_base (448)..(448): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgacccccccccgtgcaggagtcgggcccaggactggtgaggccttcgggaaccctgtctctcatctgcactgtctctggtagtttccatcagttctgatctattcgtggggctggactccggcacgccccgagggagggatggagtggagttggtgacatcattacgtacgtggggcgtacgtactactccgtccgtcccctanaagtactcgtctccactgttcgaagggacacgtccatcgaaccgtcttactccctagaaactcgaccctcgtcgaccgccgcggaccncggttccgtttattctggtacgcggtagggaccgtacggtacgttcggttacctttacgatacgtaggtcggggtccgtcggcctaccggttcggtactccgttcgtccttccgaacgtccgtaccttacccaaccggaccggtccctacggtttcccccgg

SEQ ID NO: 363694 - DNA, 638 bp, Homo sapiens
  misc_feature: GZ8MTXP02IF02J.44.86.H09.1.454.CMB.2.raw
  modified_base (358)..(358): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggatccggcacgccccgagggagggagtggaggtggagttggtgactagtcctaattagtacgtgggcgacgttactactcctccgtccccctanacgagtcgtctcacctgttcgacggacgaccgtccagtcgacctccttctcccgtacgaactacgccctccgtcgacccgcccggcggaccgacgttccgtttacttcgttgtacgcggacgggcgacgacgttggttctttacgtaagttcgttaggtccgggggtccgttcgggacctacccgggttcggtaccgtccgttcgtcccttcccgtccgtaccggtaccctttaccccggaacccgtaaaccggggtaccccctaacggtttcccccggg

SEQ ID NO: 363695 - DNA, 665 bp, Homo sapiens
  misc_feature: GZ8MTXP02HQ3KU.44.86.H09.1.454.CMB.2.raw
  modified_base (364)..(364): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttggggctggatccggcacgccccagggaggggaatggagtggattggtgacatccattatacgtggggcgacgtactactctccgtcccctacgaagtagtcgtctccactntttacggaggacctacgtaccagtacgaacccgctttactacccgtagtaaaacctcgaacccgttcccggtacgacccggcccgcgggaccaacgggtcccgtttttaacgtttccgttaggtttcgaccgggaacgggtcggaacgtaaccgttcggggtttacctttactaaacgtttcgttaaacggttccggggggtccgtttacggggccctaaaccccggtttgggtacctaccgttcgttcccgtcctcgtacgtccttcccgaaccgtaacgggccccttaagttcccccgg

SEQ ID NO: 363696 - DNA, 610 bp, Homo sapiens
  misc_feature: GZ8MTXP02G89J1.44.86.H09.1.454.CMB.2.raw
  modified_base (369)..(369): a, c, t, g, unknown or other
  modified_base (387)..(387): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgacggtccttcgggaaccctgtctctcatctgcactgtctctggtactttccatctagttctgtactctattcgtggggctggactccggcgtaccgccccgaggggtacggggaatggagtggtattgggtagactatcctattacgtacgtggggactacgtactactcctccgcccctanagtactcgtctacacgtnttcgaggacacgtccagtcgaccgtcttctaccctagaactcgcccgtcgtcgaccgcccgacgacgtcggtactttacttcgtgtcgacggtaggtacgacgtacgtggttacttacaacgttcgtagtcgggggtcctcggaccacccggtttgaccgttacgtcgttcccgtcctaacgtccgtccttaccgaccgtaaccgggcctaacgtttccccgg

SEQ ID NO: 363697 - DNA, 619 bp, Homo sapiens
  misc_feature: GZ8MTXP02FP6WL.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttgggctggatccggcacgcccccgaggggaggggaatggaggtggagttggtgacatccattatacgtggggcgacgtactactctccgtcccctacaacgtagtcgtctccacctgtttcgacggacacgtccagtcgaaacccgcttctaccctagaaacctcgtaacccgtccgtacgacccgccggaccggaccgcgggtaccgtttacttcgtagtcgcgtagggcgagtacgtgggttctttacaacttgtacggttcggggtccgtcgggaccttacccgtcggtcctacgttcggtcccttacctaacgtacgtaccttacccgaacccgaacggggtccccagtttcccccgg

SEQ ID NO: 363698 - DNA, 615 bp, Homo sapiens
  misc_feature: GZ8MTXP02HKWIU.44.86.H09.1.454.CMB.2.raw
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagagtgtccagtgtcaggtgaagctggtggagtcgtgggggaggcgtggtccagcctgggagtcctgagactctctgtgtagcgtctggcttcaccttcaacagacagtggcagtgccacgtcggggtcccgccgaggcctccgagggaccaaggggacttggggaggtggggtggactacgttagtagttggggtataggagtagggtaaattaaataattatttatagtagtaagttccggaggtaacgggccgtattaccgactactactaccaagaagtaactaaagttacggaaaacaacaactaaactaattaactacgtaagggtaaaatacgaaatacgacaggaacgacggaccggaggaacgtacgggtctacggtctaacgtacgtggcgacgaagaaggtgtcggggactggacgagttaacgaag

SEQ ID NO: 363699 - DNA, 680 bp, Homo sapiens
  misc_feature: GZ8MTXP02HK976.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctcgtcatctgcactgtctcgtggagtttccattctagttctgactctattcgtggggctggactcggcacgccccgagggagggagtggagtggacgttggagactactaccgtaagttacgtacgtacggggccgtaacgttacctaccgtccgttccgtccccctacgaagtcgtccgtcaccgtacctcgtttccggaacgggacctaccgttacacgtacgtaacccgtccttactacccctacgtaaaccgtcgtaacccgtccgacggaccccgccgaccgggacctacggttaccgtttacgtttcgtacgttcgacgaacgggcgaacgtcgttcggttactttacgaaacgttccgtaagtcccgggggtacgtcgggcctaccccggttggtacctaccgtcgttccgtccctaaggtactacccgttaccgaaccgtacgggtcccttaaccgtccccggg

SEQ ID NO: 363700 - DNA, 892 bp, Homo sapiens
  misc_feature: GZ8MTXP02GJJMU.44.86.H09.1.454.CMB.2.raw
  modified_base (284)..(284): a, c, t, g, unknown or other
  modified_base (311)..(311): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcaccttcaaacngacagtggcatgctacgtcgggtcccnccgaggccctccgaacgggacgaaacggggtacgttggggaaggtttggggtacgggacctaaacgtttttagtaacggttaggggttattagggaatttaaggggtaaaaaggtttaaaacttaaaagttatttaaaggtttacggttaaagtaacggttttccccgggtaaagggaaacgggggtacccccgttaaagttttaccccgaaacccgtaacttacccgttaacccgtaaagggaacggtaaaacctaaaacgtttacccggggaaaaacgaaaacccgtaaaaccgtaaaccctttaaaggttaacgtttaaaccgttaaagggtaaaaaacgtttaggaaaaacgttaccggtaacccggttaaaggtaaacgggaaacccgggaacccgggggtaaacggggtaaaaccccgaacccgggggtaccctttaacggggttaaacccccgtttaaatttaaaccccggtttggggtaacccggtaacgggtaaaacgggaaggttaaacggggtccggggggttaccgttaaccgggggttacggtaaaaccgtttaaacggtaaaacggg

SEQ ID NO: 363701 - DNA, 648 bp, Homo sapiens
  misc_feature: GZ8MTXP02I8HF5.44.86.H09.1.454.CMB.2.raw
  modified_base (223)..(223): a, c, t, g, unknown or other
tcagacagtatatacacgaccggtgctcgatttagtgctatagacttgggtttggggatgctttctgagagtcaaggacctcctgtgcaagaacatgaagcacctgtggttttcctcctgctggtggcagctccagatgggtcctgtccaggtgcagctgcaggagtcgggcccaggacgtggtgaggccgttcgggaaccctgtctctcatctgcatgtctntggtagtttccatctagttctgtactctattcgttggggtctggacgtccggacgaccgccccggagggacgggagtgggtagtggtagttggtagacgtatacctaagttagtacggtggggtacgtacgtactactccgtcctccctacgaagtcgtcgtctacgactgttacggacggacctacgtactaactacgacccgtctacctaccgtagtaactcgaccctcgtacgacccgcgacgacctacggttcgtttacttcgtggtacgcggacggtcgaaagttcggtcggttactttaacgtaacgttcggtaacggtcggggtcccggtcgtacccgtaccggttgtaacccttcgttccgtccgtaccgtcgtaactcccgttaaccgaccggtaaccggccctacgtttccccgg

SEQ ID NO: 363702 - DNA, 688 bp, Homo sapiens
  misc_feature: GZ8MTXP02HO5Q4.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgacggccttcgggaaccctgtctctcatctgcactgtctctggtactttccatcagtttctgattctatttcgttgggctggacgtccggcacgcccccgaggggacgggtaagtggaggtggtagttggtgtacactactagttactacggtggggcgtacgtactaccgtctcccgtcccctacgagtacgtcgtctacctacctgtttcgaacggtactaccgtccaagtacgaacccgtccttccgtaccctacgtaaaccgtcgtaaccccgtccggtacgacccgcccggacgtaccggtaccggttccgttttacgtttcgtcggttcggcgtaacggggcgtacggtacgttcggttctttaaccgaagttccgttagggtccgggggtcctcgggtccctcccggttcgggtacctccgttcggttaccctcccgttcgtccgtacccgttacccgaacccggtaccggacccgtttaacccggtttcccccgg

SEQ ID NO: 363703 - DNA, 679 bp, Homo sapiens
  misc_feature: GZ8MTXP02GB97O.44.86.H09.1.454.CMB.2.raw
  modified_base (118)..(118): a, c, t, g, unknown or other
tcagacagtatatacacgaccggtgctcgatttagtgctatagacttggggtttggggatgctttctgagagtcaaggacctcctgtgcaagaacatgaagcacctgtggtttttccncctgctggtggcagctcccagatgggtcctgtcccaggtgcagctgcaggagtcgggcccaggactggtgaggccgttcgggaaccctgtctctcatctgcactgtctctggtagtttccatcagttctgatctattcttggggctgatccgcacgccccgagggacgggagtggagtggagttggtgacagtcctagttagtacgtggggacgtaacggtactactaccgtccgtacccctactaaagagtcgtctaccacctagttcggaaggacgtaccgtacctaagtacgaaaccgtccttactacccctagtaaaactcgtaacccgtaccggttcgaacccggaccgaccgggaaacctacggggtacccgtttttaattaccgttggttacggccggtaaaagggtcccggaaagtaaccgttggggtttacccttttaaacgtaacgttacgtacgggtacggggtaccggtcggtacccgtacccgtgtacctaccgtcgtaccgtcctaacgtacgtacctaccgaaccgtaacggtaccctacgtcccg

SEQ ID NO: 363704 - DNA, 696 bp, Homo sapiens
  misc_feature: GZ8MTXP02H4J9O.44.86.H09.1.454.CMB.2.raw
  modified_base (592)..(592): a, c, t, g, unknown or other
tcagacagtatatacacgaccggtgctcgatttagtgctatagacttgggttggggagctctgggagaggagcccagcaccagaagtcggcggtgttccagtcggtgatcagcaccgaacacagaggactcaccatggagtttgggctgaccttgggttttcctcgttgcttcttttaagaggttgtccagtgtcgaggtgaagcgtgggtggagtcgtgggggaggtcgtggtccagccgtgggacgtccctgagctctctgtgtagcgtctggattccacttcaacagacagtggcatgcctagtcgggtcccgccaggtccctacgacgggtacgaaaggggtcctggggaggtggggacgtacctaagtttagtacgtagggttactaggtaagtaacgggtaaaattaaagttaaatagtttatacggttaaagtacgtttacccgggaagggtaaacgggtcccgttaatcccaaacacgttccaacgaaagtacgaactaaacggttacgaaacgtaaaccacctaaattactaacttacgtaaaggaaaagttaggaaactaacggcgtaggaaacgaccgggngaaacgaccgtacggtacttaggtaccttaaccggacgttagggtcgaacgaagggaagttaaccggtcggggtacccttagggaacggtaaactaacgtaagg

SEQ ID NO: 363705 - DNA, 620 bp, Homo sapiens
  misc_feature: GZ8MTXP02IK5KB.44.86.H09.1.454.CMB.2.raw
  modified_base (385)..(385): a, c, t, g, unknown or other
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgtactctattcgttggggctggatccggcacgcccccgagggacggggaagtggaggtggtagttggtgacatctaattatacgtgggacgtacgtactactcctccgtccccctacaagacgtcgttctcctacctntttcgacggtactaccgtaccagtcgaacccgtcttcctaccctagaaacctcgacccttccgtacgacccgccgacggaccgaccgactactttatttcgtgtcggcgacggcgtagtactggttctttacacttcgtaggtcggggaccgtcggtacctaccggtcggtactaccgttcggtcccttcgtacgtacgtaccttcccgaaccggaacgggtacccttacccggg

SEQ ID NO: 363706 - DNA, 704 bp, Homo sapiens
  misc_feature: GZ8MTXP02GI89N.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtacgttccatctagttctgatctatttcgttggggctgggacgtcccggcgacggcccccggaggggacggggtaagtgggtaaggtgggtaggttggtcgactagtcctaattacgtacggtggggtaccgtacgtactaccgtcctccgttcccccgtacaagtcgtccgtcctactacctcgtttcggaacggacctacgtacctagtacgaaccctcgttccctacccgtagtaaaccgttcgacccgtccgtccggacccgacccgggaccggtaccgtacccgggttaccggtttttactttcggttacggtcggtacgggtacggggtcgacggttacgttcggttcctttacaagtttcgtacggtcgggggtccgtcgggtcctacccggttcggtacctaccgttcgtcctccgtaacgcgttacccttacccgaccgtaccgggtacccctacggtttcccccgg

SEQ ID NO: 363707 - DNA, 593 bp, Homo sapiens
  misc_feature: GZ8MTXP02FIYAT.44.86.H09.1.454.CMB.2.raw
  modified_base (118)..(118): a, c, t, g, unknown or other
tcagacagtatatacacgaccggtgctcgatttagtgctatagacttggggtttggggatgctttctgagagtcaaggacctcctgtgcaagaacatgaagcacctgtggtttttccncctgctggtggcagctcccagatgggtcctgtcccaggtgcagctggcgggagtcgggcccaggactggtgaggccttcggggaaccctgtctctcatctgcactgtctctggactttccatcagttctgatcattcttggggctggatccggcacgcccccaggggaggggaagtggagtggattgggtgacatccattatacgtggggcgacgtactactctccgtcctccaagtacgtcgtctacaccagtttcgagggacacgtccatgaaaccgcttcctccctagaaactgaccctccgtcgaccgccgacggacacgggtcctttattctgttgcgaggcgagtaccgtggttctttactaatctagtcgggggaccgtcggcccacccgttcggtctaacctcgttcctccttaccgaagtcctttacccgaccggtaacgggaccctaacgtccggtttacccccg

SEQ ID NO: 363708 - DNA, 600 bp, Homo sapiens
  misc_feature: GZ8MTXP02I4EGY.44.86.H09.1.454.CMB.2.raw
  modified_base (246)..(246): a, c, t, g, unknown or other
  modified_base (345)..(345): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtcccngacgactctctgtgtagcgtctggacttcaccttcaacagacatggacagtcgcacgtcgggtcccgcaggcctccgaggcgaagggctgggagtgggngctacgttatgtggtatggataggaaattaatattattagtgtagtacgttcggaggaacgggtccgtatccactacgtctaccgagacaactaagtaaccgaaagaacaactaacttagtattacgtaagaaatacgaaatacgtacgtagaagacggacgaacggaccgacgtccgtagttacctacgttacgttggacggacggtaaggaagggtaggtcgggggtaccgtaggtaggtaacttaacgaagg

SEQ ID NO: 363709 - DNA, 792 bp, Homo sapiens
  misc_feature: GZ8MTXP02G7B28.44.86.H09.1.454.CMB.2.raw
tcagacagtatatacacgaccggtgctcgatttagtgctatagacttgggtttgggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctcgtggtatttccatctagttctgattctattcgttgggctggactccggcgacgcccccgaggggacggggaagtggaaggtggtagttgggtacgacgtatacctaagttagtacggtggggaccgtaaccggttacttacctccgtccgtcccccctacgaacggtcgtacgtcctactacctgtttccggaacggtaccgtaccgtaccgtactaccgtaaacccgtcctttacctaccccgtaaggtaaaacctccggtacccgttacccgtccggtaaccccggcccggtaccgggtacccgtaccgggtttacccgtttttaacgtttaccgttcgggttccggtaccgggttacggggtaccggtacggttaccggtttggggtttaccctttacaaacgttccgttaagggttccgggggtacccggttccggccgttaacccccggttagggttaccccgtaccgttccggttacccgtttaccctccgtaaccggttccccctttaccccggaaccccggtaaaccgggttcccccgtaacggttttccccccgggg

SEQ ID NO: 363710 - DNA, 657 bp, Homo sapiens
  misc_feature: GZ8MTXP02GM48S.44.86.H09.1.454.CMB.2.raw
  modified_base (313)..(313): a, c, t, g, unknown or other
  modified_base (376)..(376): a, c, t, g, unknown or other
  modified_base (508)..(508): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtcctctcatctgcactgtctctggtagtttccatcagttctgtatctacttcggttggggctggactccggcgacggccccgagggaggggaatggagtggagttggngacagtccaagtttagtacggtaggggccgtacgtaccttaccgtcttccccgtaccccctanaacgtacgtccgtcttacctactcgtttacgacggtaccaccgttaccatcgaaccgtctttactcccgtaataactccgaaccctcgtccgacccgcggccgtaccgcgttaccgttttattcgtggtcgngaggtaccgagtaccgtttcggtactttacgattacgtacgggttcggggccgtcggtaccctccgttacggtccacgttcggttcctcccgtaacgttaacgtcccttacccgaaacccggacgggtacccctaacggtttcccccgg

SEQ ID NO: 363711 - DNA, 649 bp, Homo sapiens
  misc_feature: GZ8MTXP02JZCY7.44.86.H09.1.454.CMB.2.raw
  modified_base (287)..(287): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggtccctgagacctctcctgtgtagcgtctggattcaccttcaacngacatggcatgcacgtcggtccgcaggctccgaggcgaagggactgggagtgggtgcctattatactggtatgagtaggaaagttaataagttatttataggttaagtacgtttaccggtagggaaacggggtacccgtacttaccctaaccgtattaccctacccgaaaggaaggaaacctaaacgtttaaccgaaaacgaaacctaacgtaaacttaattaacgtacgtaaagggtaaaattagtaaaatacggtcccgtaagacggaaagcccggaaagggacccaacgggtcttacggtctaacgttacgtagcgacgaaggaacgtagggtcggggtcctggtacggataacgaagg

SEQ ID NO: 363712 - DNA, 613 bp, Homo sapiens
  misc_feature: GZ8MTXP02HT5IY.44.86.H09.1.454.CMB.2.raw
  modified_base (427)..(427): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtcttctggtacgtttccattctagttctgtatcattcgtgggctggatccggcacgccccgagggagggaatggagtggagttggtgactagtccattatacgttggggctacgtactacctcgtcccgtccccctacgtaacgtacgttcgtctcccaactcgttttcggagggtacctaccgtcaacgtacgaacccgtcttcnccctagaaacctcgtaccctccgtcgacccggccgccggacaccggtccttttatttcgtgttgcggaggtcgagtacgttggtctttcaatcgtagtcggggtccgtggcctaccgtcggtacctacgttcgtcctacctcgtacgtaccttacccaccgtaaccgggtccctaacgttccccgg

SEQ ID NO: 363713 - DNA, 540 bp, Homo sapiens
  misc_feature: GZ8MTXP02HF9SS.44.86.H09.1.454.CMB.2.raw
  modified_base (245)..(245): a, c, t, g, unknown or other
  modified_base (301)..(301): a, c, t, g, unknown or other
  modified_base (365)..(365): a, c, t, g, unknown or other
  modified_base (400)..(400): a, c, t, g, unknown or other
  modified_base (420)..(420): a, c, t, g, unknown or other
  modified_base (433)..(433): a, c, t, g, unknown or other
  modified_base (449)..(449): a, c, t, g, unknown or other
  modified_base (456)..(456): a, c, t, g, unknown or other
  modified_base (477)..(477): a, c, t, g, unknown or other
  modified_base (504)..(504): a, c, t, g, unknown or other
  modified_base (517)..(517): a, c, t, g, unknown or other
tcagacagtatatacacgaccggtgctcgatttagtgctatagacttgggtttgggggatgctttctgagagtcaaggacctcctgtgcaagaacatgaagcacctgtggtttttcctcctgctggtggcagctcccagatgggtcctgtcccaggtgcagctgcagggagtcgggcccaggactggtgaggccttcgggaaccctgtctctcatctgcactgtctctggatttccatcagttcngatcattcttggggctggatcggcagcccccaggaggggatggagtggatggtganagtccattatactggggcacgtactactctccggtccccctacaacgtacgtcgtctacacccntttccgaagggacacggtccatcgaaaccgcttcncccttagaaactgacctcgngaccgcgcggacnggaccgtttatttcgngttacgngtacggcaaggctggtctttnaatctatcggggctggcaccgttggcngtcgctactcgancttcgacctacggccagtcccgg

SEQ ID NO: 363714 - DNA, 579 bp, Homo sapiens
  misc_feature: GZ8MTXP02IRKML.44.86.H09.1.454.CMB.2.raw
  modified_base (256)..(256): a, c, t, g, unknown or other
  modified_base (258)..(258): a, c, t, g, unknown or other
  modified_base (260)..(260): a, c, t, g, unknown or other
  modified_base (265)..(265): a, c, t, g, unknown or other
  modified_base (280)..(280): a, c, t, g, unknown or other
  modified_base (293)..(293): a, c, t, g, unknown or other
  modified_base (295)..(295): a, c, t, g, unknown or other
  modified_base (314)..(314): a, c, t, g, unknown or other
tcagacagtatatacacgaccggtgctcgatttagtgctatagacttgggtttggggctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctcagcactggactgcacagtggtcatttccatgctcacanancngcacnccccagacataattngatataactatananagtctgacactcgcccgtntctcacgtcctccctcgtcgggaactaacgcccgcctgtaccccttcgacgtcgcgcgtacgcctagacggtagacgaggtctgtactaagttccgtgtccttgaccttccgttccgtaagtttaggtaggtttacgacgggtattcgggttcggacgggaaggggtaccacgtcgacggtccgtacggtaggtccacggacccgaaacggtcctacccggccccgtaagtccgtacgttcccgtcgttccccgcccttcttaac

SEQ ID NO: 363715 - DNA, 597 bp, Homo sapiens
  misc_feature: GZ8MTXP02GJTHQ.44.86.H09.1.454.CMB.2.raw
  modified_base (556)..(556): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggactccggcacgcccccgagggaggggaagtggagtggagtggtagacatcctattagtacgtggggacgacgtactactctccgtccccctcaagatcgtctcacctgttcgacgggacacgtccatacgaaccgcttctaccctagaaacctcgaaccctcccgtacgacccgtacccgccgggtacgaccggtacccgttttagtttcctagtcgacgacgggacgagacgttcggtctttacaagtctagtcggggccgtgggccacccgtggtccaccgtcgtcctccncgacgtccttcccaaccgtaacggccctaacgtttccccgg

SEQ ID NO: 363716 - DNA, 587 bp, Homo sapiens
  misc_feature: GZ8MTXP02FM2FC.44.86.H09.1.454.CMB.2.raw
  modified_base (223)..(223): a, c, t, g, unknown or other
  modified_base (466)..(466): a, c, t, g, unknown or other
  modified_base (473)..(473): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcatgtcnctggtatttccatcagttctgatcattcgttggggctggatccggcacgcccccgaggggaggggaagtggaggtggagttggtgacatcctaattacgtacgtggggcgtaacgttactaactcctccgtccccctacaagagtcgtcacacctgtttcggagggacaccgtcatcgaaaccgtcttctccctagaaaacctgaaccctcgtcgaccgcgcgacacgtcgtttattctgtgngtacggngagacgtggttctttcaaatctagtcggggccgtggcctaccgtggttccacgttcgtccttcctcgacgtaccttacccgaaccgtaaaccggggtccctacgtttcccccgg

SEQ ID NO: 363717 - DNA, 575 bp, Homo sapiens
  misc_feature: GZ8MTXP02HGRU5.44.86.H09.1.454.CMB.2.raw
  modified_base (358)..(358): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattctgggctggatccggcagcccccagggaggggaatggagtggattggtgacgatccattatactggggcgacgtactactctccgtcccctcaagagtcgtctcacntttcgagggacacgtcatcgaaccgcttactccctgaaaactgaaccctccgtcgaccgccgccggacacggtaccgtttatttccaggttgccgtagggcgaagactggtctttacaattcgtagtcgggggtccgttcgggctaccccgtgggtaccacgtcgttcctccgtctacggccttacccgaaccgaaacggggccctaacttccccgg

SEQ ID NO: 363718 - DNA, 734 bp, Homo sapiens
  misc_feature: GZ8MTXP02HTZOS.44.86.H09.1.454.CMB.2.raw
  modified_base (246)..(246): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtcccngacgactctctgtgtagcgtctggacttcaccttcaaacagacagtggcatcgcgacgtgggtcccgccacggcctccgaggccgaaaggggacgtgggaggtggggtggacctacgtttaatagttaggtaagttggaagttaagggtaaaacgttaaaattaagttaacttaaagtgaccaagtaacccgttaccggtaggaaaccggggaccctaagtttacccaaccgtactccgtaacccgaagaacgaacctaaaacgttaccccgaaaagtaaacccgaccgtacttagtaacttcgtagaaaccctaaaagtacgaaaccggacaccggtaacggacgaaacgggacccgaacggggaaacccaaccggggtccgtttaggttaacggttaaacgtttaaccggtggtaccggaacggtaaacggtaaccgttaaagtttaagtttacggtttaaacccggtttaaccctaaacccccgg

SEQ ID NO: 363719 - DNA, 568 bp, Homo sapiens
  misc_feature: GZ8MTXP02GQAR2.44.86.H09.1.454.CMB.2.raw
  modified_base (283)..(283): a, c, t, g, unknown or other
  modified_base (306)..(306): a, c, t, g, unknown or other
  modified_base (346)..(346): a, c, t, g, unknown or other
  modified_base (449)..(449): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaaacngacatggcatgcacgtgggtccnccaggcctccgaggcaagggctggagtgggtgctacttanatggatgatagggaaattaataagttattatacgtagtatttccggaggaacgggccgtattaccgacctatcctaccgagtaacgaactaagttacgaaaanaaaccactaactatatacgtaggaaaattgaaacttacgccgtaggaagacgaccgaggaaccacgggtctgtacctaactcgtagtcgagagaagagtcggggctaggcgaactagag

SEQ ID NO: 363720 - DNA, 711 bp, Homo sapiens
  misc_feature: GZ8MTXP02JYRSH.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggtttttcctcctgctggtggcagctcccagatgggtcctgtcccaggtgcagctgcaggagtcgggcccaggctggtgaggccgttcgggaaccctgtctctcatctgctactgtctcgtggtacttccatctagttctgtatctagttcgttgggctggtactccggcgaccgaccccggagggagggaatggagtggtagttggtgacataccgtattagtacggtcgggtacgtaacgtactacctccgtcccgtcccctacaacgtacgttccgtactacgtaacctcgttcggaacgggtacctaccgtacctacgtacgtaaacccgtcttacctacccgtagaaaaccttccgacccgtccggtaccgaaccccggtccggaaccggtaccgttaacccgggttcgtttttaacgtccggttacggtcgggaccggtaacgggtcgttaaacgtccgtttcgggtttactttaaccgaggtaccggttggaccggggtcctacgggacccttacccggtcggtcctacgtccgttaccttccgaacgtccgtacccgttccgaaaaccggacccggtacccgttacgtcccccgg

SEQ ID NO: 363721 - DNA, 598 bp, Homo sapiens
  misc_feature: GZ8MTXP02FXMOK.44.86.H09.1.454.CMB.2.raw
  modified_base (454)..(454): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcgttggggctggatccggcacgcccccgaggggacggggaagtgggagtggagttggtgacatcctattatacgtggggcgtacgtactactctccgtcccctacaagacgtcgtctcacctgttcgacgggactaccgtccaatacgaacccgtcttacctcccgtacgaaacgtcgaccctccgtcgaccgccgtcgacnccggtccgtttattcgtgtcgcggaggcgagtacgttggttctttacgattcgtacggtggggtccgttggcctaccgtcggtctacgttcgtcctcctaacgcggtaccttcccgaaccgtaacgggccctagtttcccccgg

SEQ ID NO: 363722 - DNA, 656 bp, Homo sapiens
  misc_feature: GZ8MTXP02FIW4I.44.86.H09.1.454.CMB.2.raw
  modified_base (171)..(171): a, c, t, g, unknown or other
  modified_base (227)..(227): a, c, t, g, unknown or other
  modified_base (234)..(234): a, c, t, g, unknown or other
  modified_base (258)..(258): a, c, t, g, unknown or other
  modified_base (333)..(333): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagccgccctnagtgtctggggccccaggcagagggtcagcatcctctgcagtggagcgctccaagngcggggntaggtttgatgttacagtgtaccngcaacttcgagtacacgacccctaaatcgctacgtatttaccgactaacacctactccggaccctcgcgggtccncgtaccgtcttccgcacgtcctaccgaacgttcgtcggacctacctcgacgtcctcccgtcggaccctacgtcctacgtcgggccttaccggaggccgtggacggtagtcggtacggtcgttaggtaactttaactttaacgccgtaccgtaacgaccgttaacgtcgtaacgttaggtacgtgttggtacgtggttccggtttaggggtcggtttacggggaccggggtacggtaacccggtaacgggttccggaaacccggttccggtaacggtccgtaacccggtacccgaaaccggggtccttcccgggtaccccccgg

SEQ ID NO: 363723 - DNA, 601 bp, Homo sapiens
  misc_feature: GZ8MTXP02JCHHI.44.86.H09.1.454.CMB.2.raw
  modified_base (458)..(458): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggtatttccattcagttctgatctattcttggggctggagtccggcacgcccccgaggggacggggaatggaggtggagttggtgacatccattatacgtggggactacgtactacctctcccgtcccctacaagcgtcgtcctcacctcgtttacggacgggactaccgtccagtcgaacccgtcttcctccctacgaaactcgaaccctccgtcgacccgccgcgaccncggtccgtttattcgtgtgcgaggcgagcgttggtctttcaacgttcgtagtcggggtccgtggtcctacccgttcggtcctaccgttcggtcctcccgtcgcgttaccttaccgaccgtaaccggccctacgtttcccccgg

SEQ ID NO: 363724 - DNA, 628 bp, Homo sapiens
  misc_feature: GZ8MTXP02HZHZO.44.86.H09.1.454.CMB.2.raw
  modified_base (184)..(184): a, c, t, g, unknown or other
  modified_base (259)..(259): a, c, t, g, unknown or other
  modified_base (266)..(266): a, c, t, g, unknown or other
  modified_base (278)..(278): a, c, t, g, unknown or other
  modified_base (308)..(308): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtntccagtgtcaggtgaagctgggtggagtcgtgggggagcgtggtccaggcctgggacgtccctgagactctctgngtgcgtntggattcacttnaacagacagtggcatcgcacgtggggtccnccgaggcctccgaggcgaaaggggactggggaggtggggtgactacgtttatacgtggttactggaattagggtaaagttaaattaagttatttaagttggtaacgtaagtttcccggtaggtaaacggggtcccgtaatttccaacctagttcccgtacccgaaggaacgtaactaaagttacgaaaagaacaactaactaatactagtaaggtaaataggaaacttcgactaggaacgcgaccggagaccgacggcttaggtcctacgtactcgtagaccggaagaaggtacggtcgggggctcggtaggatacgaag

SEQ ID NO: 363725 - DNA, 802 bp, Homo sapiens
  misc_feature: GZ8MTXP02IRRM2.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatggtcctgtcccaggtgcagctgcaggagtcggcccaggactggtgacggtccgttcgggaaccctgtctctcatctgcactgtctcttggtagtttccattctagttctgtattctattcggtttggggctggtatccggcacggcccccgaggggacgggaagtgggaggtggtagttgggtgactattccgtaagttacgtacggtggggacgtacgttacgtttacctccgttcccgttaccccctacgtaacgtacgtccgttaccctcctacccgtgttttaccggagggaccctaaccgttcccaagttaccggaaacccgtcgtttaccctacccgttagaaaaccgtccgtaacccctcggtacccgacccggacccgtaccgggtaccgaccggttaccgtttttacgtttccggttacggttcgggaccggtacggggtaccggtacgttaacggtttcggtttaccttttacgtaacgtttcgttacgggggttcccgggggtcccggttcgggaccccgttaaccccgggtttcgttaacccggtaccgttttacccggttccctttcccgttaaccgtcccgtttacccgtttacccccgaaccccggtaaaaccccgggtccccttaacccgggtttttcccccccggg

SEQ ID NO: 363726 - DNA, 615 bp, Homo sapiens
  misc_feature: GZ8MTXP02FQVD1.44.86.H09.1.454.CMB.2.raw
  modified_base (455)..(455): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgaggccttcgggaaccctgtctctcatctgcactgtctcgtggatttccagtctagttctgatctattcgtgggctggatccggcacgcccccgagggagggtacgtggagtggagttggtgacgtactccgtagttagtacgtggggacgtacggtactacgtcctcccgtcccctacaacgtacgtcgtactccgtaactgtttcgaggaccacgtccatcgaacctctctccctagaaactgaaccctcgtacgaccgccgcgaccncggttcctttattcgtggtgcgacgggtacgacgtccgtaggttcctttagacgtcgttaggcgggtaccgtcggacctccccgtagtaccgtacgttcggccttccgtcgccggttaccttacccgaccggtaaacggtccccgtaagtttcccccggg

SEQ ID NO: 363727 - DNA, 636 bp, Homo sapiens
  misc_feature: GZ8MTXP02GFJ48.44.86.H09.1.454.CMB.2.raw
  modified_base (245)..(245): a, c, t, g, unknown or other
  modified_base (292)..(292): a, c, t, g, unknown or other
  modified_base (306)..(306): a, c, t, g, unknown or other
  modified_base (494)..(494): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggccaggactggtgacggccttcgggaacctgtctctcatctgcactgtctcgtggtactttcatctagttcngtatctattcgtgggctggactccggcacgccccgaggggaggtagnggagtggagtggtnatatactattacgtacggtcgggacgtaacgtactactccgtccgtacccctacgaagtacgtccgtcgtacctactgtttaccgacgggtacctaccgtaccagtacgaaaccctcttacctaccccgtagaaacctcggaaccccttcggcgtaaccccggcggtccgaacgtccggtaccgtttnttcggtgttacgcgggtacgcgtacgtacgttcgttaccttagaacgttcgtagggtcggggacgtcggtacctaccggtggtaacctcgttctccttccaagtcgtccttacccgacgtaccggtaccctcgtttccccgg

SEQ ID NO: 363728 - DNA, 765 bp, Homo sapiens
  misc_feature: GZ8MTXP02FLSKO.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgacggccttcgggaaccctgtctctcatctgcactgtctctggtacgtttccatcagttctgtactctagttcgttggggtcgtggacgtccggacgaccggacccccggaaggggagggaacgtggaggtggtagttggtagactactacctagttaacgtacggtcggggacgtaaccgttaccgtacctccgtaccgtacccccctacgaacggtacgttccgttctacctaaccgttacgttacggaacgggtactaccgtaccaattaccgaacccgttcttaccctacccgtagtaaaacctcgacccgttcccggtacgacccggtcccggaccggtaaccgtaccgggtttacccgtttttacgttccggttacggtcgggacgggtacggggtacgtaacgggtcgtttcgggtttacctttacgaaacggtttacgtaggggtcccgggggtacgggtccggtacccgtaacccggttcggttacccgtaccgttacggtccccgttaccgtccgtaaccgttacccgttacccgaacccgtacggggtaccccctacggtttcccccgg

SEQ ID NO: 363729 - DNA, 683 bp, Homo sapiens
  misc_feature: GZ8MTXP02FQCZY.44.86.H09.1.454.CMB.2.raw
  modified_base (457)..(457): a, c, t, g, unknown or other
  modified_base (631)..(631): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctccggctggtggcagctcccagatgggtcctgtcccaggtgcagctgcaggagtcggcccaggactggtgacggccttcgggaccctgtctctcatctgcactgtctcgtggtactttccatctagttctgattcagtttcgttggggctggactccgacgcgccccgaggggagggaagtggagtggtagttggtgactataccgatttagtacggtggggaccgtaacggttacctaccgtcctcccgtaccctacgacgtacgtccgttacctaccgaccttacgtttcggagggtacaacgtccagtacgacccgtcttaccctcctaacgtaacncgtaccctcccgggtacaccccgggccgaacccggtactaaccgggttccgttttaacgttcccgagttcggaccggtacgggtccgtaacgtcgttacggtttcctacgtaacgttccgtaaggtccggggtacctacgggtaccctcccggttcgtacctacgttcgtcccnccgttcgaactcccgttaacacccggaaccgtcccacgtccggtttaccccc

SEQ ID NO: 363730 - DNA, 604 bp, Homo sapiens
  misc_feature: GZ8MTXP02JG0YO.44.86.H09.1.454.CMB.2.raw
  modified_base (364)..(364): a, c, t, g, unknown or other
  modified_base (412)..(412): a, c, t, g, unknown or other
tcagacagtatatacacgaccggtgctcgatttagtgctatagacttgggtttggggatgctttctgagagtcaaggacctcctgtgcaaagaacatgaagcacctgtggtttttcctcctgctggtggcagctccagatgggtcctgtcccaggtgcagctgcaggagtcgggccaggactggtgacggccttcgggaacctgtctctcatctgcacttgtcttcgtggtactttccattctagttctgtactctattcggttgggctggacgtccggcacggaccccgaggggacgggagtggagtggagttggtgacactcattacgtacgtgggcgtactactactcgtccgtcccctanacgtctcgtctcactgttcgaggacactcatacgaccgtctctcctanaactcaccgtcgtcgaccgcgacgacgtcggttctttacttcgtgtcgcggcggacgtacgtacgttcggttactttacaagttcgtacggtcggggtccgtacggcccgtaccgtcggtacctcgttaccgtccttcctaacgtacgtccttacccggaaccgtaaccggtcccgtaacgtttcccccggg

SEQ ID NO: 363731 - DNA, 558 bp, Homo sapiens
  misc_feature: GZ8MTXP02JNB6I.44.86.H09.1.454.CMB.2.raw
  modified_base (394)..(394): a, c, t, g, unknown or other
tcagacagtatatacacgaccggtgctcgatttagtgctatagacttgggtttggggatgctttctgagagtcaaggacctcctgtgcaagaacatgaagcacctgtggttttttcctcctgctggtggcagctcccagatgggtcctgtcccaggtgcagctgcaggagtcgggcccaggactggtgaggccttcgggaaccctgtctctcatctgcactgtctctggatttccatcagttctgatcattcttgggctgatcgcagccccaggaggaatggagtgagttgtgacataccgattatacgtggggacacgtacctactctccgtaccccctcaagagtcgtctcaccatttcgagggacacgtccatcgaaactcttctcccaanactacgactcgtcgaccgcgacgacgtacgtacttattctgtcgagacgacgagtacgtgttacttacgtaattacgtagtcggtcggtacggaccgtaccgtcgtacgtacgtacgtcctcctcgtacgtacctaccgaaccgtaaccggtaccgtacgtccg

SEQ ID NO: 363732 - DNA, 625 bp, Homo sapiens
  misc_feature: GZ8MTXP02FH3YT.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccgttcgggaaccctgtctctcatctgcactgtctctggtagtttccatcagttctgatctattcgttggggctggactccggcgacgcccccgaggggacggggaagtggaggtggagttggtgactatacctagttagtacgtggggccgtacggttacctacttcctaccgtccccctacgtaacgagtcgtctaccactcttcggaggtaccacgtccactcgaacctcttacctccctagaactcgaccctccgtcgacccgccgcggacacgtccgtttatctgtgcgtaggcgacgtactggttcctttacagtcgtacgtcggggtcctcggaccctcccgttaggtcctccgttcggtcccttaccgtccgtcccggttaccttcccccgaaacccgtaccgggaccccctaggtttccccccggg

SEQ ID NO: 363733 - DNA, 736 bp, Homo sapiens
  misc_feature: GZ8MTXP02IFFTZ.44.86.H09.1.454.CMB.2.raw
tcagacagtatatacacgaccggtgctcgatttagtgctatagacttgggtttggggatgctttctgagagtcaaggacctcctgtgcaagaacatgaagcacctgttggttttcctcctgctggtggcagctcccagatgggtcctgtcccaggtgcagctgcaggagtccgggcccaggactggtgaggccgttcgggaaccctgtctctcatctgcactgtctcgtggtagtttccatctagttctgatctattcgttgggctggactccggcaccggccccggaggggaggggaagtggtaggtggtagtttggagactagtacctagttagtacggtgggacgtacgtaccttactccgtccgtcccctacaagtcgtctctactacctacgtttcggaacggaccaccgtacctacgtaccgtaacccgtcctttccctacccgtaacgtaaaccgttccggtaccccgttccggtccggacccggcccggaccgggtaacccgtccggttaccgtttttacgtttcggtacgttcggacggtacgggtacgtacggttaccggttcggtttaccgtttacgtaaacgttcgtaacggggttccggggtacccgtcggtaaccccgtcccgtttagggtacccttacccggttcgttacccgttcctaaccgtaccgtccccttaaaccccggaacggtaccccgggtacccctttacggtttccccccg

SEQ ID NO: 363734 - DNA, 530 bp, Homo sapiens
  misc_feature: GZ8MTXP02JCY5V.44.86.H09.1.454.CMB.2.raw
  modified_base (279)..(279): a, c, t, g, unknown or other
  modified_base (307)..(307): a, c, t, g, unknown or other
  modified_base (369)..(369): a, c, t, g, unknown or other
  modified_base (375)..(375): a, c, t, g, unknown or other
  modified_base (379)..(379): a, c, t, g, unknown or other
  modified_base (384)..(384): a, c, t, g, unknown or other
  modified_base (395)..(395): a, c, t, g, unknown or other
  modified_base (398)..(398): a, c, t, g, unknown or other
  modified_base (401)..(401): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccaggcctgggagtccctgagactctcctgtgtagcgtctggattcaccttnaaacagacatggacatgcacgtgggccnccaggcctccgaggcaaggggctgggagtgggtgctacttatagtgtatgatggaaattaanatatangtanttcgngagccatcacntcncanacgaacatcgaaagacacactaatatcgtaagaaactagaaatgacctaggacgacgacgagacctacggcctgtaccattacgtgtacggctaaggaagtaggtcgggggctagggtacgagtacaag

SEQ ID NO: 363735 - DNA, 716 bp, Homo sapiens
  misc_feature: GZ8MTXP02HXS99.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaaccctgtctctcatctgcactgtctcgtggtagtttccatctagttctgacttcattcgttggggctggactccggcacgccccgaggggacgggtagtggaggtggtagttggagaacgtactcctaattacgtacgtggggtacctacgtactacctctacccgtcccctataacgcgtcgtactccgactagtttcggacggtacctaccgtacctaacgtcgtaacccgtcttaccctacccgtaagtaaccgtacgtaacccgttccgtccgtaacccggcccggaccggtaccgtaccggttaccgttttacttccgtaggtacggaccggttagggaccgtacgtacggttacggttccgtttaaccgaagttaccggtaggtaacccgggggtccttaccggggtcccttaaacccgttacgggtcccttactcggttaaccctccgttaaccgtacgttacccttacccgaaccgttaaaccggggccccttaaacggtttccccccgg

SEQ ID NO: 363736 - DNA, 608 bp, Homo sapiens
  misc_feature: GZ8MTXP02JIMSJ.44.86.H09.1.454.CMB.2.raw
  modified_base (247)..(247): a, c, t, g, unknown or other
  modified_base (272)..(272): a, c, t, g, unknown or other
  modified_base (281)..(281): a, c, t, g, unknown or other
  modified_base (285)..(285): a, c, t, g, unknown or other
  modified_base (306)..(306): a, c, t, g, unknown or other
  modified_base (348)..(348): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacgtccngacgactctctgtgtagcgtctggnttcaccttnaacngacatggcatgcacgtggccnccaggcctcgaggcaaagggctgggagtggggcgctatttanagtggtatgaagtggaaattaataagttattagtcgtaagagtttccggaggaacgggtccgtattccgacctatctaccgagacgaactaacgttacgaaagtaaaccactaacgtaattacgtacgtaagggtaaatagaaacgtacgcctaggaacggacgacccggaggaccgaacgggtcttacgtaacctacgttaagtcggtagccgtaaaggaagtacgggtcggggtccttagggtagtaacgtacgaaag

SEQ ID NO: 363737 - DNA, 670 bp, Homo sapiens
  misc_feature: GZ8MTXP02IM8AR.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggttttcctcctgctggtggcagctcccagatgggtcctgtcccaggtgcagctgcaggagtcgggcccaggactggtgaggccttcgggaacctgtctctcatctgcactgtctcgtggtatttccatctagttctgatctattcgttggggctggacgtccggcaccgcccccgaaggggacggggaagtgggaggtaggagttgggtgactagtcctattagtacggtggggcgtaacgtactacctcgtccgtcccctacgaacgtacgtccgtactcccaaccttacgtttccggaacgggtacctacgtacctagtaccgaacccgttcttcctcccgtagaaacctcggtaccctccgtcgacccggtccggacgaccgtaccggttcctttacgttccgtggtcgacggtagggaccgtaacgtgttcgggtttctttacgaacgttcgtacggtcgggggtcccgtgggtaccctcccggttacgggtacctcgttcggtcccttctccgtaacgtcccttaccgaccggtaacggcccctaggtttcccccgg

SEQ ID NO: 363738 - DNA, 555 bp, Homo sapiens
  misc_feature: GZ8MTXP02IEPRT.44.86.H09.1.454.CMB.2.raw
  modified_base (445)..(445): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgatctattcgttggggctggactccggcgacgcccccgaaggggaggggaatggaggtggagttggtagactatcctagttatacggtggggtcgtaccgtactacctcttcccgtcccctacaagcgtcgtctaccactgttcggaggacacgtccatcgacctctctcctagaactcacctcgcgaccgtcgcgacncgtcttatcgtgtgcggagcgtagcgttggtcttcatcgtagtcggtcgtacgcctccggtgtcacgttcgtctccgtcacgtcctaccacgtacggccctacgttcccg

SEQ ID NO: 363739 - DNA, 736 bp, Homo sapiens
  misc_feature: GZ8MTXP02GAXMC.44.86.H09.1.454.CMB.2.raw
  modified_base (230)..(230): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggacgtcgggcccaggacgtggtgacggtccgttcgggaaccctgtctctcatctgcactgtctntggtatttccatctagttctgtactctattcggttggggcgtggacgtccgggcgaccggaccccgggaggggggagtgggaggtggtagttggtgacactctattagtacgtggggacgtacgtactacctcctaccccgtcctaccgtaacgtcgtccgtacctcctaaccgttacgtttccggaacggtaccgtaccgtaccgtacgtaccgtaacccgtccttccctacccgttaaacgaaacccgtccgtacccgttacccgtacccgaccccggtcccggtaccggacccgtacccgggtttccgtttttacgttcgttacggtcggtacgggaccggtaacgggacgttacggttcgttactttaacgttaacgttcgtacgggtcgggggtccctcggcccttaccggtcgttacgtccgttcgttccgtccctacgtaacgttccccggtaacccaaccgggtcccgtaacccgttccgttccccggtttccccccg

SEQ ID NO: 363740 - DNA, 686 bp, Homo sapiens
  misc_feature: GZ8MTXP02IA2DB.44.86.H09.1.454.CMB.2.raw
  modified_base (481)..(481): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttggctgaccttgggttttcctcgttgcttcttttaagaggtgtccagtgtcgaggtgaagcgtgggtggaggtcgtgggggaggcgtggtccagccgtgggacgtccctgacgctctctgtgtagcgtctggattccaccttacaaacagacagtcggcagtcgccgtacgtccggggtcccgccgaggtccctaccgagggaccgaaaggggtcgtaggggaggtggggtcgaccttagttatagtcggtagtagagtaggaaaagttaaattaagttagtttatagttaacgtattaccgggagaacgggccccgttatcccaacctagttacccncgaaagtacgaactaaacgttaccggaaataaaccaaacctaattaatagtttaccgaaggtaaattacggaaactaccggaacgtggaaacggcgaccgggaagggtacccagggttacccttggtaaacctttaccgaggttcggacggaggaaacggggtggtacggggttcggggacgttacgggtaggtaactaacgaag

SEQ ID NO: 363741 - DNA, 647 bp, Homo sapiens
  misc_feature: GZ8MTXP02IS0QW.44.86.H09.1.454.CMB.2.raw
  modified_base (117)..(117): a, c, t, g, unknown or other
  modified_base (183)..(183): a, c, t, g, unknown or other
  modified_base (479)..(479): a, c, t, g, unknown or other
  modified_base (611)..(611): a, c, t, g, unknown or other
tcagacagtatatacacgaccggtgctcgatttagtgctatagacttgggtttggggatgctttctgagagtcaaggacctcctgtgcaagaacatgaagcacctgtggtttttccncctgctggtgcagctccagatgggtcctgtccaggtgcagctgcaggagtcgggcccaggactggngacggtccttccgggaacctgtcctctcatctgcactgtctcgtggtactttcattctagttctgatctattcggtgggactggacgtccgacgacgcccccgaaggggtagggaacgtggacggttaggagtttggagaactacgtacctaagttacgttacggtcgggtacgtaacccggttacttaccccgtcgtaccccgtaccccgttaccgaacgtacggttccggtacctacccgtaccgttagtttacgggaacggtaaccgtacccgtacgacgtcgtaaacccgtnttacccgtacctcgaaactcgtacccgtacgtccgaccgtcccgagaccgtcggttacgtttcttcgacggtgcgggtacgcgtacgtacgtgttctaacgtgtacgttgcgggtacgtcgacgcgtcgtcnctcgtctacgtcgctctacacgtacgcctgttcccg

SEQ ID NO: 363742 - DNA, 764 bp, Homo sapiens
  misc_feature: GZ8MTXP02FJIXJ.44.86.H09.1.454.CMB.2.raw
  modified_base (286)..(286): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggaggtcgtgggggaggcggtggtccagccgtgggacggtccctggagactctcctgtgtgcgtctggattccaccttnaaacagactatggacatcgcacggtcggggtcccgccgaggcctacccgagggaccgaaaggggacctggggaacgggttggggtgggactaacgttttaagtaacgttaggggtaatagtaaggttagggtaaaaagtttaaaattaaattagtttaaattagggttaacgtaacgtttacccgggtaggggaaaccggggtacccgtaatttacccgaaccctacttacccgtacccgtaaagaccgtaaactaaacgttacggaaaacgtaaaccaaacctaaccttaaagttaattaccgtaaaaggtaaaagttagtaaaagttaacgtacccgtaggaaacggacggacccgggaaacggaccggtaacgggtcgttaccggttacctaaaccggttacgttacggtacggaacggtaaggaagggtaagggtcgggggtacgttcggggtaacggtaacgttaacggaaag

SEQ ID NO: 363743 - DNA, 656 bp, Homo sapiens
  misc_feature: GZ8MTXP02FH4PI.44.86.H09.1.454.CMB.2.raw
  modified_base (209)..(209): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttggggttttcctcgttgcttcttttaagaggtgtccagtgtcaggtgaagctggnggagtcgtgggggagcgtggtccagccgtgggagtccctgagactctcctgtgtagcgtctggtattcaccttcaacagacatggcagtcgcacgtcgggtccgccaggcctaccgaggcgaaacggggaccgtgggaaggttggggtcggctacgttaatagtaggtataggataggggaaaattaaattaaatacttaatagttaagtacgtttcccggtaggtaaacggggcctaatttcccaacccagttccctacccgagaacgaactaagttacgaaaacgaactaacacttaatatactaaggtaaaatgaaacgttgaccgagaaacggacggacggtaacggaacgaaccggggtcttacggttacctacgtaaccttgggtacgaccggaagggtaagtaacggtagggggtccctaagggttcggtaagtcgacgg

SEQ ID NO: 363744 - DNA, 684 bp, Homo sapiens
  misc_feature: GZ8MTXP02HSO6Z.44.86.H09.1.454.CMB.2.raw
  modified_base (185)..(185): a, c, t, g, unknown or other
tcagacagtatatacacgaccggtgctcgatttagtgctatagacttgggttggggagctctgggagaggagcccagcaccagaagtcggcggtgtttccagtcggtgatcagcaccgaacacagaggactcaccatggagtttgggctgaccttgggttttcctgttgcttcttttaagaggtntccagtgtcaagtgaagctggtggagtcgtgggggaggcgtggtccagccgtgggacgtcctgagactctcctgtgtagcgtctggattccacccttcaaacagacagtggacagtcgacacgttcggggtccccgaccgaggcctaccgagggacgaaacggggcgtaggggaggttggggtcgactaacgtttataccggtggtaataggaagttaggtaaacgttaaaattaaattatttaagtagttaagtaacgttccgggtaaagggaaacggggtccttaagtaccctaacccgtattacccgacgaaagacgtaaactaagttaccgaaataaaccaactaactaattactacgaagtaaatagaacgtagtaccgtaagacggtaacgaccggaaagtaccggaacggtcttacggtacttaaaccgtcgttcggacgtacggaaggtaacggtaggggtacggtcggtacgtacgggaattaacgaagg

SEQ ID NO: 363745 - DNA, 871 bp, Homo sapiens
  misc_feature: GZ8MTXP02GI2GG.44.86.H09.1.454.CMB.2.raw
  modified_base (276)..(276): a, c, t, g, unknown or other
tcagacagtatatacacgaccggtgctcgatttagtgctatagacttgggtttggggatgctttctgagagtcaaggacctcctgtgcaagaacatgaagcacctgtggtttttcctcctgctggtggcagctccagatgggtcctgtcccaggtgcagctgcaggagtcgggcccaggactggtgacggtccgttcgggaaccctgtctctcatctcgcactgtctctggtagtttccatctgttctgatactattcgtgggctggactccggcncggaccccgaggggaggagtggagtggtagttggtgacatacgtagttacgtacggtcgggtcgtacgttacctaccgtccttcccgtaccccccgtagaacgtacgtccgtactaccctaacctcggtttaccggaacgggtaaccgtaccgtacccgtaaacgtaccggtaaaccccgttcccgtttacccgtacccgttaacggaaaacccgttaccgtaacccccgttacccgggttccccgggaaacccccggccccggggtaccccgggttaaacccgggtaaccccggggttttaacccgttttttccggtttaacccggtttggggtttaacccgggacccggggttaaacgggggcccgtaaccggttaaacccgggttttcggtttacccgttttaaaccgaaaccggtttcgtttaaaacgggggttcccccgggggtccgttaacccggggtacccccttaccccggggttcgttaacccggttaccgttcccgggttaccccttcccgtaacgtaaacccgttcccggttaaaccccaaccccggtaaaaccggggtccccctaaccgggtttaccccccgg

SEQ ID NO: 363746 - DNA, 693 bp, Homo sapiens
  misc_feature: GZ8MTXP02I36HQ.44.86.H09.1.454.CMB.2.raw
  modified_base (167)..(167): a, c, t, g, unknown or other
tcagacagtatatacacgaccggtgctcgatttagtgctatagacttgggtttggggatgctttctgagagtcatggacctcctgtgcaagaacatgaagcacctgtggttcttcctcctgctggtggcggctccagatgggtcctgtcccagctgcagctgcaggngtcggccaggctggtgaagccgttggacgaccctgtccctcacctgcacgtgtctcgtaggtgcctcatcagcagtagtacgttactacgtgggctggactcccggaccgacggtacccccggaaggggaacgggcgtggaggtggtaggtaggagttacgtacttagtttaagtggtaggacgtacctaccgtaaacgtaccaaccccccggtacctacgaacgtacgtacgacgttacaccgtaatactacgaagtacgacgtaaccgtaacccaaagaaccctacgttcccacccgttaggaaactcgttgaacgtcgttctacgacgaccccggaccggaccgacgaaccgggtcccgttaaaggtctttaacggcgttacggacggacggttaacggggtacggtaccgttaacgtccggttaaaccaaaaccgtttacgtaacgttttaccgaaccgtacgtaaccggggaccgtaacggttaacccgacgtaccggtacccgtctacccctacgccccg

SEQ ID NO: 363747 - DNA, 583 bp, Homo sapiens
  misc_feature: GZ8MTXP02JA2PT.44.86.H09.1.454.CMB.2.raw
  modified_base (311)..(311): a, c, t, g, unknown or other
  modified_base (316)..(316): a, c, t, g, unknown or other
  modified_base (445)..(445): a, c, t, g, unknown or other
  modified_base (553)..(553): a, c, t, g, unknown or other
tcagacagtatatacacgaccggtgctcgatttagtgctatagacttgggtttgggcacaagaggcagcactcaggacaatctccagcatggcctggtctcctctcctcctcactctcctcgctcactgcacagggtcctgggcccagtctgtgctgacgcagcccgtcctcagtgtcgtcggggccccagggcagagggtcagcactctccgtgctagttcgggagtccggctaccgaacgacgggcggggtactagggttttgagttgttacagtacgtaccagacctactcgaagacaccaccccaangactntattacactacactcgtccgcctcggacggtccctagacgtacttccacgacgcttacagtctcggccaccgtccgactccccgtcgcgcctacgtcaccgtggcctcgagtcgtagaggcgtaggcgntacggtatttattaccgcgtaccacgtacttaccgagtactagtagttcgaggttagtcgttcggttagggtcggtacgggtacggacggacgttaacgcgtaaccgngtacgcgacgaccgtacgcctaccgtcccg

SEQ ID NO: 363748 - DNA, 692 bp, Homo sapiens
  misc_feature: GZ8MTXP02GFG38.44.86.H09.1.454.CMB.2.raw
tcagacagtatatacacgaccggtgctcgatttagtgctatagacttgggtttggggatgctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggtagtttccatctagttctgactctattcttggggctggatccggcacgccccgagggaggggaactggagtggagttggtgacatcattagtagtggggacgtacgtactactctccgtcccctcaagacgtcgtctcaccttagttcgacgggactacgtccagtcgaaccgtcttaccctcctacgaaacctgacccttccggtacggaacccgcccggacggaccaccgggtttaccgttttactttcgtacgttcggacgtaccgggacgaccgttacgttggttacccttttagaacttacgtacgggttccggggtaccgggttcggtaccccgttaacccggtcggggttaaccctaccggtttccggttcccgtttccccgaacgttacccggttccctttaccccgaaacccggtaaaaccgggggtcccccttaaacggttttcccccccgggg

SEQ ID NO: 363749 - DNA, 440 bp, Homo sapiens
  misc_feature: GZ8MTXP01ASHK6.10.77.G11.1.454.CMB.2.raw
  modified_base (434)..(434): a, c, t, g, unknown or other
  modified_base (436)..(440): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctgggggcacgagcggccctgggctgccctggtcaagggctacttcccactactatgctgagcgggctggcaaggcgcatagngnnnnn

SEQ ID NO: 363750 - DNA, 437 bp, Homo sapiens
  misc_feature: GZ8MTXP01DDN6N.10.77.G11.1.454.CMB.2.raw
  modified_base (431)..(431): a, c, t, g, unknown or other
  modified_base (434)..(437): a, c, t, g, unknown or other
tcagcatagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaaggcccatcggtctccccctggcaccctcctccaagacgcacctcctgggggcacagcggccctgggctgcctggtcaaggactactcccactactatgctgagcgggctggcaaggcgcatagngtnnnn

SEQ ID NO: 363751 - DNA, 438 bp, Homo sapiens
  misc_feature: GZ8MTXP01D00PT.10.77.G11.1.454.CMB.2.raw
  modified_base (432)..(438): a, c, t, g, unknown or other
tcagcatagtagtgcacgaccggtgctcgatttagctagtcactcaagggaaagggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaaggcccatcggtcttccccctggcaccctcctccaagagcacctcctgggggcacagcggccctgggctgcctgggtcaagggctacttcccactactatgctgagcgggctggcaaggcgcatagnnnnnnn

SEQ ID NO: 363752 - DNA, 471 bp, Homo sapiens
  misc_feature: GZ8MTXP01BEHB3.10.77.G11.1.454.CMB.2.raw
  modified_base (463)..(463): a, c, t, g, unknown or other
  modified_base (465)..(471): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaagggaccacggtcaccgtctcctcacgcctccaccgaacgggccccatccggtccttcccccgtggcccacccctcctcccaagacgccacctccgtcgggggcacgacgccggcccctggggctggccctgggtcaaggactacttcccactactatgctgagcgggctggccgaaggcgcagtagngnnnnnnn

SEQ ID NO: 363753 - DNA, 448 bp, Homo sapiens
  misc_feature: GZ8MTXP01EK7DC.10.77.G11.1.454.CMB.2.raw
  modified_base (442)..(442): a, c, t, g, unknown or other
  modified_base (444)..(448): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtctggggccaagggaccacggtcaccgtctcctcagcctccaccaagggcccatcggtcttccccctggccacccgtcctccaagagcacctccgtgggggcacagccggccctgggctgccctgggtcaagggactacttcccactactatgctgagcggctggcaaggcgcatagngnnnnn

SEQ ID NO: 363754 - DNA, 441 bp, Homo sapiens
  misc_feature: GZ8MTXP01EX3U5.10.77.G11.1.454.CMB.2.raw
  modified_base (346)..(346): a, c, t, g, unknown or other
  modified_base (435)..(435): a, c, t, g, unknown or other
  modified_base (437)..(441): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaatggacgtctggggccaagggaccacggtcaccgtctcctcagcctccaccaaggcccatcggtctccccctggccaccctcctccaagngcacctcctgggggcacagccggccctgggctgcctggtcaaggctacttcccactactatgctgagcgggctgggcaaggcgcatagngnnnnn

SEQ ID NO: 363755 - DNA, 445 bp, Homo sapiens
  misc_feature: GZ8MTXP01EBTM0.10.77.G11.1.454.CMB.2.raw
  modified_base (351)..(351): a, c, t, g, unknown or other
  modified_base (439)..(439): a, c, t, g, unknown or other
  modified_base (441)..(445): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccgcggggggggcaatggacgtctggggccaagggaccacggtcaccggtctcctcagcctccaccaagggccccatccggtcttccccctggccaccctcctccaagngcacctcctgggggcacagcgcccctgggctgccctggtcaagggctacttcccactactatgctgagcgggctggcaggcgcatagngnnnnn

SEQ ID NO: 363756 - DNA, 441 bp, Homo sapiens
  misc_feature: GZ8MTXP01EFWNW.10.77.G11.1.454.CMB.2.raw
  modified_base (434)..(434): a, c, t, g, unknown or other
  modified_base (436)..(441): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggccaccctcctccaagagcacctctgggggcacagcgccctgggctgcctgggtcaaggactacttcccactactatgctgagcgggctggcaaggcgcatagngnnnnnn

SEQ ID NO: 363757 - DNA, 460 bp, Homo sapiens
  misc_feature: GZ8MTXP01APXYM.10.77.G11.1.454.CMB.2.raw
  modified_base (453)..(453): a, c, t, g, unknown or other
  modified_base (455)..(460): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaagtggacgtcgtggggccaagggaccacggtcaccgtctcctcagcctccaccaaggcccatccggtcttccccctggccaccctcctccaacgagccacctccgtcgggggcacgacgccggcccctggggcctgcccgtgggtccaagggactacttccccactactatgctgagcgggctggcaaggcgcatagngnnnnnn

SEQ ID NO: 363758 - DNA, 658 bp, Homo sapiens
  misc_feature: GZ8MTXP01DBQFR.10.77.G11.1.454.CMB.2.raw
  modified_base (201)..(201): a, c, t, g, unknown or other
  modified_base (239)..(239): a, c, t, g, unknown or other
  modified_base (278)..(278): a, c, t, g, unknown or other
  modified_base (281)..(281): a, c, t, g, unknown or other
  modified_base (298)..(298): a, c, t, g, unknown or other
  modified_base (301)..(301): a, c, t, g, unknown or other
tcagcatagtagtgcacgaccggtgctcgatttagctagtcactcaagggaaggggaggaactgctcagttaggacccagagggaaccatggaagccccagctcagcttctcttcctcctgctactctggctcccagattccaccggagaagttgtgttgacacagtctccagccacctgtctttgtctccgaggggaaangccaccctctcctgcagggccagtcagagtcttagganctccttagcctggtatcaacagaaacctggccaggcccnccncgctcctctactctatnatncactaccaacgacggaccacgtcgccacctaccgacgaccgtacgtcgtacggtcggacgtaggtcgggtcggtacgggacgaacgtacgttacctacctcctaccaccactacacgacgaacgaacgtacgacgtaccgtaagtaagttagttttacgttacgttaacgtttaacgtttaacgttacgttacggtacgtacgtacgtacgtacgtaccgtaccgtaccggtaccggtaccggtaccgggttaccgggtaccggaacgggtaaaccggtaaacggttacggtacgacgtaacgaacgttacgttacgttacggtcggtcgtcgacgtaccttacttcgttcccgttc

SEQ ID NO: 363759 - DNA, 441 bp, Homo sapiens
  misc_feature: GZ8MTXP01DDACG.10.77.G11.1.454.CMB.2.raw
  modified_base (435)..(441): a, c, t, g, unknown or other
tcagcatagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaaggcccatcggtcttccccctggcaccctcctccaagagcacctcctgggggcacagcggccctggggctgcctgggtcaagggactactcccactactatgctgagcgggctggcaaggcgcataggnnnnnnn

SEQ ID NO: 363760 - DNA, 439 bp, Homo sapiens
  misc_feature: GZ8MTXP01DIRJF.10.77.G11.1.454.CMB.2.raw
  modified_base (433)..(439): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaaggcccatcggtcttccccctggcaccctctccaagagcacctcctgggggcacgagcggcccctgggctgcctggtcaaggctactcccactactatgctgagcgggctggcaaggcgcataggnnnnnnn

SEQ ID NO: 363761 - DNA, 445 bp, Homo sapiens
  misc_feature: GZ8MTXP01DLINN.10.77.G11.1.454.CMB.2.raw
  modified_base (439)..(439): a, c, t, g, unknown or other
  modified_base (441)..(445): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccggcgggggggggcaaagtggacgtctgggggccaagggaccacggtcaccgtctcctcagcctccaccaagggcccatcggtcttccccctggcaccctcctccaagagcacctcctgggggcacagcggccctgggctgcctggtcaaggactacttcccactactatgctgagcgggctggcaagcgcatagngnnnnn

SEQ ID NO: 363762 - DNA, 457 bp, Homo sapiens
  misc_feature: GZ8MTXP01CM8X7.10.77.G11.1.454.CMB.2.raw
  modified_base (445)..(445): a, c, t, g, unknown or other
  modified_base (447)..(457): a, c, t, g, unknown or other
tcagcatagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaagggaccacggtcaccgtctcctcagcctccaccaagggccccagtccggtcttcccccgtggccacccctcctccaagcgcacctccgtcgggggcacgagccggccctgggctgccctggtcaagctactcccactacatcgctgacgcgggctggcgaagcgcatagngnnnnnnnnnnn

SEQ ID NO: 363763 - DNA, 456 bp, Homo sapiens
  misc_feature: GZ8MTXP01DEH62.10.77.G11.1.454.CMB.2.raw
  modified_base (449)..(449): a, c, t, g, unknown or other
  modified_base (451)..(456): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccggcgggggggggcaagtggacgtcgtggggccgaagggaccacggtcacccgtctcctcagcctccaccaagggcccatcggtctccccctggcaccctcctccaagacgcacctccgtggggggcacacgccggcccctgggctgccgtggtcaacggactacttccccactactatgctgagcgggctggcaaggcgcatagngnnnnnn

SEQ ID NO: 363764 - DNA, 433 bp, Homo sapiens
  misc_feature: GZ8MTXP01DRT1S.10.77.G11.1.454.CMB.2.raw
  modified_base (336)..(336): a, c, t, g, unknown or other
  modified_base (342)..(342): a, c, t, g, unknown or other
  modified_base (350)..(350): a, c, t, g, unknown or other
  modified_base (427)..(427): a, c, t, g, unknown or other
  modified_base (429)..(433): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagaccaattccaagaacacgttggatctgcaaatgaacagcctgagagccgacgacacggccgtatattactgtgcgaaagatacgtggacacatgtatggtccggcggggggggcaatggacgtcgtggggccaaagggaccacggtcaccgtctcctcagcctccaccaaggccatcggtctcccctggcaccnctcagngcacctcnggggcacagcggccctgggctgcctggtcaaggactacttcccactactatgctgagcggctggcaaggcgcatagngnnnnn

SEQ ID NO: 363765 - DNA, 471 bp, Homo sapiens
  misc_feature: GZ8MTXP01AN7C2.10.77.G11.1.454.CMB.2.raw
  modified_base (448)..(448): a, c, t, g, unknown or other
  modified_base (454)..(454): a, c, t, g, unknown or other
  modified_base (456)..(456): a, c, t, g, unknown or other
  modified_base (458)..(471): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaatggacgtctggggcccaagggaccacggtcaccgtctcctcagccctccaccaacgggccccatccggtcttccccctggcccacccctcctcccaagcgcacctccgtgggggcacgacgcggccctggggctggccctgggtcaacggctacttccccactactatgctgaggcgggctggcaagggcnctaagngngnnnnnnnnnnnnnn

SEQ ID NO: 363766 - DNA, 486 bp, Homo sapiens
  misc_feature: GZ8MTXP01CAC2X.10.77.G11.1.454.CMB.2.raw
  modified_base (476)..(476): a, c, t, g, unknown or other
  modified_base (478)..(483): a, c, t, g, unknown or other
  modified_base (485)..(486): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtgggtccggcggggggggcaagtggacgtcgtggggccaagggaccacggtcaccgtctcctcagccctccaccgaacgggccccatccggtccttccccccgtggcccacccctcctaccaagacgcaccgtccgtgggggcacgacgccggcccgtgggcctgcccgtgggtacaaggactacctcccactactatcgccgtgaggcgggtcacggacgaacggcgacaagtagngnnnnnnann

SEQ ID NO: 363767 - DNA, 512 bp, Homo sapiens
  misc_feature: GZ8MTXP01C2DS0.10.77.G11.1.454.CMB.2.raw
  modified_base (502)..(502): a, c, t, g, unknown or other
  modified_base (504)..(512): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtgggtccgggcgggggggggcaagtggacgtcgtggggccaagggaccacggtcaccgtctcctcagccctccaccaacgggcccatccggtccttccccccgtggcccaccccgtcctaccaagacgccacctccgtcggggggacacgacggccggccccgttgggcctcggcccgttgggtaccaaacggggtaccttaccttccccacttactactcgctggaacggccggggctgggacgaaacggccgacaagtagngnnnnnnnnn

SEQ ID NO: 363768 - DNA, 451 bp, Homo sapiens
  misc_feature: GZ8MTXP01C2UUU.10.77.G11.1.454.CMB.2.raw
  modified_base (440)..(440): a, c, t, g, unknown or other
  modified_base (442)..(451): a, c, t, g, unknown or other
tcagcatagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccggcggggggggcaagtggacgtcgtggggccaagggaccacggtcaccgtctcctcagcctccaccaaggcccatcggtctccccctggccaccctcctccaagacgcacctccgtgggggcacgagcggccctgggctgccctggtcaaggactactcccactactatgctgagcgggctggcaaggcgcataggngnnnnnnnnnn

SEQ ID NO: 363769 - DNA, 584 bp, Homo sapiens
  misc_feature: GZ8MTXP01EPBZ4.10.77.G11.1.454.CMB.2.raw
  modified_base (201)..(201): a, c, t, g, unknown or other
  modified_base (210)..(210): a, c, t, g, unknown or other
  modified_base (398)..(398): a, c, t, g, unknown or other
  modified_base (439)..(439): a, c, t, g, unknown or other
  modified_base (449)..(449): a, c, t, g, unknown or other
  modified_base (551)..(551): a, c, t, g, unknown or other
  modified_base (564)..(564): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccacctgtctttgtctccaggggaangccaccctntcctgcagggccagtcagagtcttaggatctccttagcctggtactacaacacgaaacctggaccaggcctcccaggcctcctcatctatgatgacactacccaacgacggggccctaacgtcgggccacgtcccccgagcccgtagggttccaaggtgggacgtagggtggggtctaacggggaacncggtacttcaccttctaccaaccatccagcaagactagacncgtagaattnttttgacttagtttattacgtgttacagcgtaagtcgtacgctaacgtcggtccgtcggtacgttccggacgaacgggaacaaggttgaccttgacgaacgngaccttggcgtcncgccacttgtccgttgttcc

SEQ ID NO: 363770 - DNA, 469 bp, Homo sapiens
  misc_feature: GZ8MTXP01A7YPK.10.77.G11.1.454.CMB.2.raw
  modified_base (452)..(452): a, c, t, g, unknown or other
  modified_base (458)..(458): a, c, t, g, unknown or other
  modified_base (460)..(469): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatgggtccggcggggggggcaagtggacgtcgtggggccaagggaccacggtcaccgtctcctcagccctccaccaaggccccatccggtcttccccctggcccacccctcctccaagacgccacctccgtgggggcacgacgccggccctggggctgcccgtgggtaccaaggtcctacttccccactactatgctgagcgggctgggcaaggcncatagngnnnnnnnnnn

SEQ ID NO: 363771 - DNA, 443 bp, Homo sapiens
  misc_feature: GZ8MTXP01EMJZ9.10.77.G11.1.454.CMB.2.raw
  modified_base (257)..(257): a, c, t, g, unknown or other
  modified_base (280)..(280): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagccgttanggtaatcgaaacagaaacctggnccacggcgtcccacgctcctcatctatgactacgccaactacccgaaccacgggccgacctacggccagtccccccaggtccgaggttcgacgtagggtcggtaacgtggggtacgtaggggactacgacgttcctactacctacaccagtcagacacgacac

SEQ ID NO: 363772 - DNA, 527 bp, Homo sapiens
  misc_feature: GZ8MTXP01BVZ3B.10.77.G11.1.454.CMB.2.raw
  modified_base (387)..(387): a, c, t, g, unknown or other
  modified_base (516)..(516): a, c, t, g, unknown or other
  modified_base (518)..(527): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgacaaatgaacagcctgagagccgacgacacggccgtatattactgtgacgaaagatacgtaggacacatgtagtgggtccggggcgggggggcaagtggacgtcgtggggccaagggaccacggtcaccgtctcctcgacgccctacccaccgaacgggccccacgtccggtcccttccccccgtggccctacccctcctaccaagcgccaccgtccgngggggcacgacggcccggcccctgggcctcggcccgttgggtaccaaacggggtacccttaccgttaccccaacttacctactcgtcgtcggaggccggggcgtagggaccgaacgggcgcgaagtagngnnnnnnnnnn

SEQ ID NO: 363773 - DNA, 644 bp, Homo sapiens
  misc_feature: GZ8MTXP01A07GU.10.77.G11.1.454.CMB.2.raw
  modified_base (203)..(203): a, c, t, g, unknown or other
  modified_base (448)..(448): a, c, t, g, unknown or other
tcagcatagtagtgcacgaccggtgctcgatttagctagtcactcaaggggaaagggggaggaactgctcagttaggacccagagggaaccatggaagccccagctcagcttctcttcctcctgctactctggctccagattccaccggagaagttgtgttgacacagtctccagccacctgtctttgtctccgaggggaaanagccaccctctcctgcagggccagtcagagtcttaggagctccttagcctggtatacaacagaaacctggaccaggcctcccaggtcctcctctatctatcgatcgaccatacccaacgacgggtcccacgtggaccactccccaaggcctagggttcaggtcggacgtagggttcggggtcgtaaggggacctaagtacctttcaacctctacacagtcagcagactagacgcttaggaacttnttttacgacttaagttttatacgtgtacgaacgtcgtaagtccgtaagcctaaacggttcggaaccccgtcggggtaccgttaccggggaccggaaacggggtaacccgaaaggttcgggaaacacgttaacgaacgacccgggttacttagggtcgggccttaacggccctaccttattcccggttaagttcccc

SEQ ID NO: 363774 - DNA, 632 bp, Homo sapiens
  misc_feature: GZ8MTXP01DCWBS.10.77.G11.1.454.CMB.2.raw
  modified_base (243)..(243): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccacctgtctttgtctccgaggggaaagcgccaccctctcctgcgaggccagtcagagttcttagganctccttagccgtaggtactacaacagaaacctcggaccacggcctcccgaggtcctacctcattctatgatcgacaactcccaaacggacggcccacgtcggacactcccgagccgtaggttcacggtggacgtagggtcggggtctaaggggactcgtacttccacctcctccaaccagtcacgtcaacggtacgtaagacgtaccgtaaggtaaactttagttttcgaacttagtttaacttagttcgtcaacggtcgaaggtcgtaagcctaacggtcgggtcccgtcgggtacgtacccggacggaacgggtaaacgaaggttcgggaaccagtaacgaagacgttaacgttggtcggctcggactcacgtttcttaacgtttcc

SEQ ID NO: 363775 - DNA, 433 bp, Homo sapiens
  misc_feature: GZ8MTXP01DOYOV.10.77.G11.1.454.CMB.2.raw
  modified_base (338)..(338): a, c, t, g, unknown or other
  modified_base (425)..(425): a, c, t, g, unknown or other
  modified_base (427)..(433): a, c, t, g, unknown or other
tcagcatagtagtgcacgaccggtgctcgatttagctagtcactcaagggaagggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctcaccaaggcccatcggtctcccctggcaccctcctcaagngcacctctgggggcacagcggccctgggctgcctggtcaagggactacttcccactactatgctgagcgggctggcaagcgcatagngnnnnnnn

SEQ ID NO: 363776 - DNA, 619 bp, Homo sapiens
  misc_feature: GZ8MTXP01D8Q3E.10.77.G11.1.454.CMB.2.raw
  modified_base (203)..(203): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaancgccaccctctcctgcagggccagtcagagttctaggagctccttagcctggtatcaacagaaacctggccggctcccgaggctcctcatctatgatgctattacgaacgtagggccaacgtggccaactccccagcccgtaggttccaggtcggacgaggtggggtctggggaaaccaggtccttcaccgtctcacccatcagcagtaactagacgtccgtagtaacgttatttcgacttaagtttatactgtacagggctaggtaccgtagccgtaacgtcgggtcccgtacggggtaccgttccgggaaccggtaaacggggaacccgtaaaagtcgggaaacacgttacggaaacggtcggttaaacgttggttacgccgtagcctaactcggttctaacgttctttaaccg

SEQ ID NO: 363777 - DNA, 491 bp, Homo sapiens
  misc_feature: GZ8MTXP01D97YU.10.77.G11.1.454.CMB.2.raw
  modified_base (474)..(474): a, c, t, g, unknown or other
  modified_base (477)..(477): a, c, t, g, unknown or other
  modified_base (479)..(491): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaaatgaacagcctgagagccgacgacacggccgtatattactgtgcgaaagatacgtggacacatgtatgggtccggcggggggggcaagtggacgtcgtggggccaaagggaccacggtcaccgtctcctcacgcctccaccgaaacggcccatccggtccttccccctggcccaccctcctccaaagacgcacctccgtcgggggcacgacgccggccccttggggccttcggccctacgggtacaaacgggacctaccgtttccccaactactatgctgagcgggctggcaaggcgctaanagngnnnnnnnnnnnnn

SEQ ID NO: 363778 - DNA, 458 bp, Homo sapiens
  misc_feature: GZ8MTXP01BBWD1.10.77.G11.1.454.CMB.2.raw
  modified_base (454)..(454): a, c, t, g, unknown or other
  modified_base (456)..(458): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaagggaccacggtcaccgtctcctcagcctccaccgaacggccccatccggtccttccccctggccaccctcctccaacgacgcacctccgtcgggggcacgagccggcccttcggggctgccctgggtcaagggactacttcccactactatgctgagcgggctggcaaggcgcatagngnnn

SEQ ID NO: 363779 - DNA, 567 bp, Homo sapiens
  misc_feature: GZ8MTXP01AG2WN.10.77.G11.1.454.CMB.2.raw
  modified_base (531)..(531): a, c, t, g, unknown or other
  modified_base (533)..(533): a, c, t, g, unknown or other
  modified_base (535)..(535): a, c, t, g, unknown or other
  modified_base (537)..(539): a, c, t, g, unknown or other
  modified_base (541)..(543): a, c, t, g, unknown or other
  modified_base (545)..(567): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtgggtccgggcgggggggcaagtggacgtcggtggggccaagggaccacggtccaccgtcctcctcacgccctccgaccgaacggccccacgtcccggtcctcccccgtggcccacccctcctacaagcgccaccgtccgtcgggggcacgacgcccggccccgtggggccttcgggcccgttagggtacctaaggggtacccttacccgttaccccaacgttacgtaacgtcgtcgtaggaacggtccgggggcgtacggggaccgaaacgggcccggaacgtagtagcgngngngnnncnnncnnnnnnnnnnnnnnnnnnnnnnn

SEQ ID NO: 363780 - DNA, 800 bp, Homo sapiens
  misc_feature: GZ8MTXP01EY4WC.10.77.G11.1.454.CMB.2.raw
  modified_base (204)..(204): a, c, t, g, unknown or other
  modified_base (243)..(243): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanacgccaccctctcctgcagggccagtcagagtcttaggnctccttagcctggtatcaacagaaccgtggcccggctcccgaggcctcctcatctatgatcgactactacccaaacgacggggcccaacgtggacccacgtcccccgaggtcccctaaggggtttcccaagggtttccgggaccgtaagggggttcgggggttacgtacggggggaaaaccctaagggttaaccctttacccgaaacccgttcccttaccccgaaacccctacgttaccgaacggtaccgtaaacggtaaccgttaacgggaaccggtacccgttaagggttaaaacggtttacgtttttttacgggaaccgttttaagttttaacgtttaccgttagggttaccaaggggtaccgtaaggtaccggttaacgaccgtaaccgtcgggtacccgtacggggttaccggtaccgggtaaccggtaaacggggaaccgtaaacgggtcggaacgtaacgttaacgaaacgggtaccgttaaacgggttcggttacgggtccgtacggtcccgtaaccgtacggttcctttcggttaacccgtttaaccg

SEQ ID NO: 363781 - DNA, 522 bp, Homo sapiens
  misc_feature: GZ8MTXP01C2CHL.10.77.G11.1.454.CMB.2.raw
  modified_base (503)..(503): a, c, t, g, unknown or other
  modified_base (507)..(507): a, c, t, g, unknown or other
  modified_base (509)..(522): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgacaaatgaacagcctgagagccgacgacacggccgtatattactgtgacgaaagatacgtgacacagtgtagtgggtccgggcggggggggacaagtggacgtcgtggggccgaagggaccacggtcacccgtctcctcagccctcccaccgaacgggccccacgtccggtcccttcccccctggccctacccctcctccaaacgacgccacccgtccgtcggggggacacgacggcccggccccgtggggctcggcccgttgggtacaacgggaccttacctccccgactactagcgtctggaggcggggctcgggacgaaacgggcgccgaanaggngnnnnnnnnnnnnnn

SEQ ID NO: 363782 - DNA, 565 bp, Homo sapiens
  misc_feature: GZ8MTXP01DDQLJ.10.77.G11.1.454.CMB.2.raw
  modified_base (533)..(533): a, c, t, g, unknown or other
  modified_base (535)..(535): a, c, t, g, unknown or other
  modified_base (537)..(565): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgacaaatgaacagcctgagagccgacgacgacggccgtattatactgtgacgaaagatacggtggaacactagtggtagtcgggtccgggggcggggggggacaaggtggacgtcggtcggggaccaagggacctacggtccaacccgttctccctacagcccctaccaccgacggccacgtccggtccctaccccgtcggacccctaccccgtcctacgaacgtacgcctaccgtccggcggggaccacgacggcccggtcccgtcgggctcggccgttaggtaccgaacggtaccttccgtacccaacttacgtatcggtcgtcggacgggccgggttcacgggaccaaaggggccaggtaaangngnnnnnnnnnnnnnnnnnnnnnnnnnnnnn

SEQ ID NO: 363783 - DNA, 613 bp, Homo sapiens
  misc_feature: GZ8MTXP01BYV6W.10.77.G11.1.454.CMB.2.raw
  modified_base (596)..(596): a, c, t, g, unknown or other
  modified_base (598)..(613): a, c, t, g, unknown or other
tcagcatagtagtgcacgaccggtgctcgatttagctagtcactcaagggaaaggggctggagtgggtctcaggtattagtggtagtggtgatggcacatactacgcagactccgtggaagggccggttcagcatctccagagacaattccaagaacacgttggatctgacaaatgaacagcctgagacgccgacgacgacggccgtatattactgtagacgaaagatacgtggaacacagtgtagtcgggtccggggcgggggggacaagtgggacgtgtcgggggaccaacgggccacggtcacccgtctcctcacgccctccaaccgaacgggccccacgtcccggttacccttccccccgtggacccctaccccctccctaccaaacgacgtcccgaacccgtcccggtacgggggggaccaaccggaccggccccggggtacccccgttgggggtcccgtcgggtccccggttacggggtaaccccgaaacggggttaccccttaaccccgtttacccccaaacgttaccttaacgttcgacgttcgggaacggccggggtcgtaggacccggaaaggcccgatagtaggngnnnnnnnnnnnnnnnn

SEQ ID NO: 363784 - DNA, 573 bp, Homo sapiens
  misc_feature: GZ8MTXP01ALN9V.10.77.G11.1.454.CMB.2.raw
  modified_base (234)..(234): a, c, t, g, unknown or other
  modified_base (514)..(514): a, c, t, g, unknown or other
  modified_base (548)..(548): a, c, t, g, unknown or other
  modified_base (550)..(573): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacanatgtagtggtccggcggggggggacaagtgggacgtcgtcggggacccgaaaggggaccccgtacgggtccacccggtctcccctcgaccggtcccttaccccgaacccggaaacggggcccccaacgtcccggttccctttaccccccgtcggcccaacccccgttcccctccgaaacgtacgccacccgtcccgtcggggggcaccgacggtccgcccgttcggggctccggaccgtgggacaacgggcttaacctccccgactactatgtacctggnggccggggactggggcaacgggtccgacataggngnnnnnnnnnnnnnnnnnnnnnnnn

SEQ ID NO: 363785 - DNA, 592 bp, Homo sapiens
  misc_feature: GZ8MTXP01ATEEV.10.77.G11.1.454.CMB.2.raw
  modified_base (230)..(230): a, c, t, g, unknown or other
  modified_base (494)..(494): a, c, t, g, unknown or other
  modified_base (555)..(555): a, c, t, g, unknown or other
  modified_base (557)..(561): a, c, t, g, unknown or other
  modified_base (564)..(566): a, c, t, g, unknown or other
  modified_base (568)..(576): a, c, t, g, unknown or other
  modified_base (578)..(580): a, c, t, g, unknown or other
  modified_base (582)..(592): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagactaacttccaagaacacgttggatctgacaaatgaacagcctagagacgccgacgacgacggtccgtatattactgtgacgaaagngtacggtagacatagtggttagtcgggtccgggggcggggggacaaggtcggacgtcggtcgggaccgaacggaccgacggtcaccgtctcctcacgccctaccgaccgacggcctacgtaccgtccttcccccgcggccctacccgtcctaccgaacgacgccgtaccgtccgggtcggggactaacgcggcccggtcccgttagggccttacggcccgtagggtccgtaaaggtaaccccttcgtaccctacgtacgttacncggtacgtcggacgggtaccggcgttaccggacccggaaagggtccgaacgaacgtagcgngnnnnncgnnngnnnnnnnnngnnngnnnnnnnnnnn

SEQ ID NO: 363786 - DNA, 680 bp, Homo sapiens
  misc_feature: GZ8MTXP01CPKNA.10.77.G11.1.454.CMB.2.raw
tcagcatagtagtgcacgaccggtgctcgatttagctagtcactcgaagggaaaggggctggagtgggtctcaggtattagtggtagtggtgatggcacatactacgcagactccgtgaaggccggttcagcatctccagagacaattccaagaacacgttggatctgacaaatgaacagcctgagagccgacgacgacggcctatatactgtgacgaagatacgtggacacatgtagtggtccgggcggggggcaagtcggacgtcgtggggaccaggaccacggtccaaccgtctccgtacacgcctaccaccgacggaccctagtccggttaccctcccccgtggaccctacccgtcccgtaccgaaggaccgttaccgaaccccgttccggtacggggggaccacggaacgggtccccggtaccccggttaggggtccctcgggtaccccgttacgggttaaacccgaacgggtaccccttaacccgttaccccgtaaccttaaccgttaacgtacgccgttacggtaaaccggccggggttaccgtacgggacccgaaaggggccccttaacgaacgggtttaacgacggtacgtacgtacgtacgtacgtacgtacgtacgtacgacgtacgtacgtacgtacgtaacgtacgttacgtacgttaccgtacgta

SEQ ID NO: 363787 - DNA, 507 bp, Homo sapiens
  misc_feature: GZ8MTXP01D58U8.10.77.G11.1.454.CMB.2.raw
  modified_base (197)..(197): a, c, t, g, unknown or other
  modified_base (205)..(205): a, c, t, g, unknown or other
  modified_base (232)..(232): a, c, t, g, unknown or other
  modified_base (246)..(246): a, c, t, g, unknown or other
  modified_base (266)..(266): a, c, t, g, unknown or other
  modified_base (337)..(337): a, c, t, g, unknown or other
  modified_base (362)..(362): a, c, t, g, unknown or other
  modified_base (476)..(476): a, c, t, g, unknown or other
  modified_base (486)..(486): a, c, t, g, unknown or other
  modified_base (505)..(505): a, c, t, g, unknown or other
tcagcatagtagtgcacgaccggtgctcgatttagctagtcactcaagggaaaggggaggaactgctcagttaggacccagagggaaccatggaagccccagctcagcttctcttcctcctgctactctggctcccagattccacggagaagttgtgttgacacagtctccagccacctgtctttgctccagggaangccacctntcctgcaggccagtcagagtcttaggnctctagctgatcanagaactgcagctccagctcnatctatgatgctatccaaacaggccaactcgacacgtccagccagtcacgtgacaggtcggtctagggacnggacttcacttcgcaaccatccaancagactagagctagaagatttgctagtttatactgtcaggccaagccgtagccaacgtggacccttaggaacgttcgaccgaaggtaaaccaaaggttggaacagtacaaacgngttaaaccgngtaagctgcacactcgttntc

SEQ ID NO: 363788 - DNA, 437 bp, Homo sapiens
  misc_feature: GZ8MTXP02IVH20.10.77.G11.1.454.CMB.2.raw
  modified_base (344)..(344): a, c, t, g, unknown or other
  modified_base (430)..(437): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaagtggacgtctggggccaagggaccacggtcaccgtctcctcagcctccaccaaggcccatcggtctccccctggcaccctcctccaagngcacctcctggggcacagcggccctgggctgcctggtcaaggactacttcccactactatgctgagcggctggcaaggcgcatagnnnnnnnn

SEQ ID NO: 363789 - DNA, 439 bp, Homo sapiens
  misc_feature: GZ8MTXP02ITSK9.10.77.G11.1.454.CMB.2.raw
  modified_base (435)..(439): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggcaatggacgtctggggccaagggaccacggtcaccgtctcctcagcctccaccaagggcccatcggtcttccccctggccaccctcctcccaagagcacctcctggggcacagcggccctgggctgcctggtcaagggactacttcccactacctatgctgagcgggctggcaaggcgcatagnnnnn

SEQ ID NO: 363790 - DNA, 434 bp, Homo sapiens
  misc_feature: GZ8MTXP02H3UZQ.10.77.G11.1.454.CMB.2.raw
  modified_base (429)..(434): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccgaagggaccacggtcaccggtctcctcagcctccaccaaggcccatcggtctccccctggcaccctctccaaagcgcacctctggggcacagcgccctgggctgctggtcaagctactcccactactatgctgagtcggctggcaagcgcatagnnnnnn

SEQ ID NO: 363791 - DNA, 441 bp, Homo sapiens
  misc_feature: GZ8MTXP02GKAK5.10.77.G11.1.454.CMB.2.raw
  modified_base (431)..(441): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggccaccctcctccaagagcacctcctggggcacagcgccctgggctgcctggtcaaggactacttcccactactatgctgagcggctggcaaggcgcatagnnnnnnnnnnn

SEQ ID NO: 363792 - DNA, 432 bp, Homo sapiens
  misc_feature: GZ8MTXP02HOBUJ.10.77.G11.1.454.CMB.2.raw
  modified_base (429)..(432): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaaggcccatcggtctccccctggcaccctcctccaagacgcacctcctggggcacagcggccctgggctgcctggtcaaggactacttcccatactatgctgagcggctggcaaggcgcatagnnnn

SEQ ID NO: 363793 - DNA, 507 bp, Homo sapiens
  misc_feature: GZ8MTXP02JN076.10.77.G11.1.454.CMB.2.raw
  modified_base (341)..(341): a, c, t, g, unknown or other
  modified_base (491)..(507): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaaggggaccacggtcaccgtcctcctcacgcctccaccgaacggcccagtccggtcccttcccccgnggcccaccctcctaccaacgcgcctacctccggtcggggcacgacggccggccgtcgggctcgccgtcggtaccgaacggtaccttacccgtcccaccttactacgtcgtcgtaggacggcgggtcgtcgggacgaacgggcgacagagnnnnnnnnnnnnnnnnn

SEQ ID NO: 363794 - DNA, 440 bp, Homo sapiens
  misc_feature: GZ8MTXP02JFJ7H.10.77.G11.1.454.CMB.2.raw
  modified_base (431)..(440): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggccaccctcctccaagagcacctcctggggcacagcgccctgggctgcctggtcaaggctacttcccactactatgctgagcgggctggcaaggcgcatagnnnnnnnnnn

SEQ ID NO: 363795 - DNA, 435 bp, Homo sapiens
  misc_feature: GZ8MTXP02IRD2E.10.77.G11.1.454.CMB.2.raw
  modified_base (430)..(435): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggcaatggacgtctggggccaagggaccacggtcaccggtctcctcagcctccaccaaggcccatccggtctccccctggcaccctcctccaagagcacctcctggggcacagcggccctgggctgcctggtcaagggctacttcccactactatgctgagcgggctggcaagcgcatagnnnnnn

SEQ ID NO: 363796 - DNA, 436 bp, Homo sapiens
  misc_feature: GZ8MTXP02F56IO.10.77.G11.1.454.CMB.2.raw
  modified_base (433)..(436): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggccaccctcctccaagagcacctcctggggcacagcggccctgggctgcctggtcaaggactacttcccactactatgctgagcgggctggcaaggcgcatagnnnn

SEQ ID NO: 363797 - DNA, 438 bp, Homo sapiens
  misc_feature: GZ8MTXP02JYS3T.10.77.G11.1.454.CMB.2.raw
  modified_base (432)..(438): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtctccccctggcaccctcctccaagagcacctcctgggggcacagcggccctggggctgcctggtcaaggctacttcccactactatgctgagcgggctggcaaggcgcatagnnnnnnn

SEQ ID NO: 363798 - DNA, 430 bp, Homo sapiens
  misc_feature: GZ8MTXP02H6JUH.10.77.G11.1.454.CMB.2.raw
  modified_base (341)..(341): a, c, t, g, unknown or other
  modified_base (430)..(430): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggcaatggacgtctggggccaagggaccacggtcaccgtctcctcagcctccaccaaggcccatcggtctcccctggcaccctcctccaagngcacctcctgggggcacagcggccctgggctgcctgggtcaagggctacttcccactactatgctgagcgggctggcaaggcgcatagn

SEQ ID NO: 363799 - DNA, 442 bp, Homo sapiens
  misc_feature: GZ8MTXP02ISZ2Q.10.77.G11.1.454.CMB.2.raw
  modified_base (436)..(442): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccacaaggcccatccggtcttccccctggccaccctcctcccaagacgcacctcctcgggggcacagcgccctgggctgcctggtcaaggactacttcccactactatgctgagcgggctggcaaggcgcgatagnnnnnnn

SEQ ID NO: 363800 - DNA, 454 bp, Homo sapiens
  misc_feature: GZ8MTXP02JKNTV.10.77.G11.1.454.CMB.2.raw
  modified_base (246)..(246): a, c, t, g, unknown or other
  modified_base (422)..(422): a, c, t, g, unknown or other
  modified_base (447)..(454): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggngggggggcaagtggacgtcgtggggccaagggaccacggtcaccgtctcctcacgcctccaccaacgggccccatccggtccttcccccgtggcccaccctcctccaagacgccacctccgtggggcacgacgcggccctgggctcgcctggtcaaggactacctcccactactangctgagcggctggcaaggcgcatgnnnnnnnn

SEQ ID NO: 363801 - DNA, 455 bp, Homo sapiens
  misc_feature: GZ8MTXP02GDHMO.10.77.G11.1.454.CMB.2.raw
  modified_base (450)..(455): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaagggaccacggtcaccgtctcctcagcctccaccaagggcccatccggtccttccccctggcccacccctcctccaagacgccaccgtccccgggggcacgagccggccctgggctgcctggtcaaggacctacttcccactactatgctgagcgggctggcaaggcgacatagnnnnnn

SEQ ID NO: 363802 - DNA, 508 bp, Homo sapiens
  misc_feature: GZ8MTXP02HE9ZM.10.77.G11.1.454.CMB.2.raw
  modified_base (465)..(465): a, c, t, g, unknown or other
  modified_base (483)..(508): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacgggtcaccgtcctcctcacgcctccaccgaacggcccagtccgtccttccccgtcggcccacccctcctacccaaacgacgaccctacctcccggtcgggggaccacgacggcccggtccccgtgggcctcgccgtcggtaccgaacggtacctaccttcccactactatcgctgaggcgggtcnggacgaaggcacagtagnnnnnnnnnnnnnnnnnnnnnnnnnn

SEQ ID NO: 363803 - DNA, 442 bp, Homo sapiens
  misc_feature: GZ8MTXP02G5VUP.10.77.G11.1.454.CMB.2.raw
  modified_base (437)..(442): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggcaagtggacgtctggggccaagggaccacggtcaccgtctcctcagcctccaccaagggcccatcggtctccccctggccaccctcctccaagacgcacctcctgggggcacgagcggccctgggctgcctggtcaaggactacttcccactactatgctgagcgggctggcaaggcgcatagnnnnnn

SEQ ID NO: 363804 - DNA, 483 bp, Homo sapiens
  misc_feature: GZ8MTXP02IA0VP.10.77.G11.1.454.CMB.2.raw
  modified_base (474)..(483): a, c, t, g, unknown or other
tcagcatagtagtgcacgaccggtgctcgatttagctagtcactcaagggaaaggggctggagtaggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggcaagtggacgtcgtggggccaagggaccacggtcaccgtctcctcagcctccaccgaacgggtccatccggtcttccccctggccaccctcctccaaagacgccacctcccgtgggggcaccgaggccggccccgtcgggccgtcgcccgtgggtccaaacgggtacctaccttccccactacgtactcgctggagtcgggcgtggcgaaggcgcagtagnnnnnnnnnn

SEQ ID NO: 363805 - DNA, 471 bp, Homo sapiens
  misc_feature: GZ8MTXP02H6BCZ.10.77.G11.1.454.CMB.2.raw
  modified_base (187)..(187): a, c, t, g, unknown or other
  modified_base (463)..(471): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgaganccgacgacacggccgtatattactgtgcgaaagatacgtggacacatgtatggtccggcgggggggcaagtggacgtcgtggggccaagggaccacgggtcaccgtctcctcacgcctccaccgaacgggccccagtccggtccttccccccgtggccacccctcctccaacgacgccacctccgtcgggggcaccgacgccggcccgtcggggctcggcctggtccaaggcctacttcccactacatcgctgagcgggctggcaaggcgcatagnnnnnnnnn

SEQ ID NO: 363806 - DNA, 463 bp, Homo sapiens
  misc_feature: GZ8MTXP02JB885.10.77.G11.1.454.CMB.2.raw
  modified_base (350)..(350): a, c, t, g, unknown or other
  modified_base (360)..(360): a, c, t, g, unknown or other
  modified_base (439)..(463): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggcaagtggacgtcgtggggccaagggccacggtcaccgtctcctcagcctccaccaagggccccatccggtcctccccctggccaccctcctccaagngcacctccgnggggcacagcggccctgggctgcctgtcaaggctactcccactacctatgctgacgcggctcggacaaggcgacatagnnnnnnnnnnnnnnnnnnnnnnnnn

SEQ ID NO: 363807 - DNA, 444 bp, Homo sapiens
  misc_feature: GZ8MTXP02GR4ZO.10.77.G11.1.454.CMB.2.raw
  modified_base (429)..(429): a, c, t, g, unknown or other
  modified_base (435)..(444): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaatggacgtctggggccaagggaccacggtcaccgtctcctcagcctccaccaagggcccatcggtcttccccctggccaccctcctccaagacgcacctcctggggcacacgcgccctgggcctgccctggtcaagctacttcccatactatgctgagcgggctggcaaggcncatagnnnnnnnnnn

SEQ ID NO: 363808 - DNA, 438 bp, Homo sapiens
  misc_feature: GZ8MTXP02GRV34.10.77.G11.1.454.CMB.2.raw
  modified_base (435)..(438): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaaagggcccatcggtcttccccctggcaccctcctccaaagagcacctcctgggggcacagcggccctgggctgcctggtcaaggactacttcccactactatgctgagcgggctggcaaaggcgcatannnn

SEQ ID NO: 363809 - DNA, 441 bp, Homo sapiens
  misc_feature: GZ8MTXP02I02KQ.10.77.G11.1.454.CMB.2.raw
  modified_base (435)..(441): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaagtggacgtctggggccaagggaccacggtcaccgtctcctcagcctccaccaaggcccatccggtcttccccctggccaccctcctccaagacgcacctcctggggcacacgcgccctgggctgcctggtcaaggactaccttcccactactatgctgagcggctggcaaggcgcatagnnnnnnn

SEQ ID NO: 363810 - DNA, 456 bp, Homo sapiens
  misc_feature: GZ8MTXP02JYBYU.10.77.G11.1.454.CMB.2.raw
  modified_base (359)..(359): a, c, t, g, unknown or other
  modified_base (448)..(448): a, c, t, g, unknown or other
  modified_base (450)..(450): a, c, t, g, unknown or other
  modified_base (452)..(456): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtatggtccggcgggggggcaagtggacgtcgtggggccaagggaccacggtcaccgtctcctcacgcctccaccgaagggccccatccggtccttcccccgtggccacccctcctccaagacnccacctccgtggggcacgacgcggccctgggctgcctggtcaaggactaccttcccactactatcgctgagcgggctggcgaaggcganangnnnnn

SEQ ID NO: 363811 - DNA, 516 bp, Homo sapiens
  misc_feature: GZ8MTXP02IP9OC.10.77.G11.1.454.CMB.2.raw
  modified_base (202)..(202): a, c, t, g, unknown or other
  modified_base (288)..(288): a, c, t, g, unknown or other
  modified_base (308)..(308): a, c, t, g, unknown or other
  modified_base (353)..(353): a, c, t, g, unknown or other
  modified_base (500)..(500): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccaccctctcctgcagggccagtcagagtcttaggagctccttagcctggtatcaacagaaacctggccaggctcccaggctccncatctatgatgcatccaacnggccactggcatccccagccaggttcagtgcagtggtctgggacngtacttcactctcaccatcagcagactagacgcctagaacgtattttgactagtttattacttgttcagtcagcgtagcaacgtcggcctcggacgttcggaccgaacgggaaccgaaaggtcggactagtacgaacgacgaactgngctgcacactctgttc

SEQ ID NO: 363812 - DNA, 436 bp, Homo sapiens
  misc_feature: GZ8MTXP02FV0VR.10.77.G11.1.454.CMB.2.raw
  modified_base (346)..(346): a, c, t, g, unknown or other
  modified_base (432)..(436): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagngcacctcctgggggcacagcggccctgggctgcctggtcaaggactacttcccactactatgctgagcggctggcaagcgcatagnnnnn

SEQ ID NO: 363813 - DNA, 443 bp, Homo sapiens
  misc_feature: GZ8MTXP02GIVQX.10.77.G11.1.454.CMB.2.raw
  modified_base (440)..(443): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtcgtggggccaagggaccacggtcaccgtctcctcagcctccaccaagggcccatccggtcttccccctggccacccctcctccaagacgcacctccgtgggggcacagcggccctgggctgcctggtcaaggactacttcccactactatgctgagcgggctggcaaggcgcatagnnnn

SEQ ID NO: 363814 - DNA, 441 bp, Homo sapiens
  misc_feature: GZ8MTXP02GIAR3.10.77.G11.1.454.CMB.2.raw
  modified_base (439)..(441): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaaagagcacctcctgggggcacagcggcccctggggctgcctgggtcaaggactacttcccactactactgctgagcgggctggcaaggcgcatagnnn

SEQ ID NO: 363815 - DNA, 443 bp, Homo sapiens
  misc_feature: GZ8MTXP02GWHRS.10.77.G11.1.454.CMB.2.raw
  modified_base (433)..(443): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaagtggacgtctggggccaagggaccacggtcaccgtctcctcagcctccaccaagggccccatcggtcttccccctggccacccgtcctccaagagcacctcctggggcacagcgccctgggctgcctggtcaagggctactcccactactatgctgagcggctggcaaggcgcatagnnnnnnnnnnn

SEQ ID NO: 363816 - DNA, 447 bp, Homo sapiens
  misc_feature: GZ8MTXP02HI0E0.10.77.G11.1.454.CMB.2.raw
  modified_base (348)..(348): a, c, t, g, unknown or other
  modified_base (356)..(356): a, c, t, g, unknown or other
  modified_base (362)..(362): a, c, t, g, unknown or other
  modified_base (429)..(429): a, c, t, g, unknown or other
  modified_base (433)..(433): a, c, t, g, unknown or other
  modified_base (436)..(447): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcgggggggcaagtggacgtcgtggggccaagggaccacggtcaccggtctcctcagcctccaccaagggcccatcggtcctcccctggccaccctctccaagncactccgnggggcncagcgccctgggctgctgtcaacggactacctcccactactatcgctgagcgggctggccaagggcnctanagnnnnnnnnnnnn

SEQ ID NO: 363817 - DNA, 729 bp, Homo sapiens
  misc_feature: GZ8MTXP02I4Y6U.10.77.G11.1.454.CMB.2.raw
  modified_base (202)..(202): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccacctctcctgcagggccagtcagagtcttaggagctcctagcctggtatcaacagaaacctggcccggctcccgaggcctcctcatctatgatgcactcccaaacgacgggccaacgtcggacctactccccgagcccgtaggttccaggtcggacaggtggggtcgtggggactaggtcctttccacttcctaccaaccctataccaagaccaagaacctaaggaacgtcccgtaagtaaaagttatttttacggacctttaaaggtttttaacttaaccgtttaggttaccaaggtaccgtaaggtaccggttaacgacccgtaaaacggttccggggtaccccggttaccgggggttaaaccggtttcccggggtaaaccccggaaaacgggggaaacccctaaaaacggggtcgggaaaacctaacggttaaaccgaaaacggtaccgtaaaaccggttgggtacggggaacttaccggacccgtaaccctacgttaccgttcgttacccgtttaacccg

SEQ ID NO: 363818 - DNA, 435 bp, Homo sapiens
  misc_feature: GZ8MTXP02HZYAV.10.77.G11.1.454.CMB.2.raw
  modified_base (351)..(351): a, c, t, g, unknown or other
  modified_base (433)..(435): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggccccatcggtcttccccctggcaccctcctccagagcaccncctgggggccacagcggccctgggctgcctggtcaaggctacttcccactactatgctgagcgggctggcaaggcgcatagnnn

SEQ ID NO: 363819 - DNA, 698 bp, Homo sapiens
  misc_feature: GZ8MTXP02G1HSX.10.77.G11.1.454.CMB.2.raw
  modified_base (201)..(201): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccacctgtctttgctccgaggggaancgccaccctctcctgcagggccagtcagagttctaggacgcttccttagccttggtatcaacgagaacctggccaggcctcccgaggcctcctcatctatgatgacactacccgaacgacgggcccaacgtcgggaccacgttccccgagtccgtagggtttcacgggttcggcctaggggtcggggttacgtaggggaactaggtacctttccgaaccttcctacccacctatccgaagtccaaacgtacgtaacggacgtacccgttaaggtaacgtttagtttttaccggaactttaagttttacttaacgtcgttacgacgtacgtaacggtacgtaagaccgttaacgttcgggacccgttacggggtaccgttaccggggaccgtaaaacgggaacccgtaaaaggtacgggaaccacgttaacggaacggacgtaacggttcgtaacgggtaccacggtacctaacccgtagttccgttacgttttcccg

SEQ ID NO: 363820 - DNA, 457 bp, Homo sapiens
  misc_feature: GZ8MTXP02FZ0VO.10.77.G11.1.454.CMB.2.raw
  modified_base (352)..(352): a, c, t, g, unknown or other
  modified_base (443)..(443): a, c, t, g, unknown or other
  modified_base (449)..(457): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtgacacatgtatggtccggcgggggggcaagtggacgtcgtggggccgaagggaccacggtcaccgtctcctcagcctccaccgaggcccatccggccttcccccgtggcccaccctcctccaagnccactccgtggggcacagcggcctgggctcgccgtgtacacggtactaccttcccgactactatgcgtagagtcgggcctggaccaaggcncatagnnnnnnnnn

SEQ ID NO: 363821 - DNA, 478 bp, Homo sapiens
  misc_feature: GZ8MTXP02F5MIW.10.77.G11.1.454.CMB.2.raw
  modified_base (469)..(469): a, c, t, g, unknown or other
  modified_base (472)..(478): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctacaaatgaacagcctgagagccgacgacacggccgtatattactgtgcgaaagatacgtggacacatgtatggtccggcggggggggcaagtggacgtcgtggggccaagggaccacggtcaccgtctcctcacgccctccaccaagggccccacgtcggtcccttccccccgtggcccaccccgtccctcccgaaacgacgccacccgtcgtcgggggccacgacgccggcccgtgggctcgcctggtcaaacggcctacgtacccactactatcgctgacgcgggctcggcaaggcacanagnnnnnnn

SEQ ID NO: 363822 - DNA, 513 bp, Homo sapiens
  misc_feature: GZ8MTXP02HF3PR.10.77.G11.1.454.CMB.2.raw
  modified_base (342)..(342): a, c, t, g, unknown or other
  modified_base (471)..(471): a, c, t, g, unknown or other
  modified_base (493)..(513): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaaggggaccacgggtcaccgtctcctcacgcctccaccgaacgggccccagtccggtccttccccccnggcccacccctccctaccaaacgacgcccaccgtcccgtgggggccaacgagccggccccgtggggcctggcctggtacgaacggtcctaccgttccccaactacctatcgcgtggacggccggggtcngggaccgaaggccgactagagnnnnnnnnnnnnnnnnnnnnn

SEQ ID NO: 363823 - DNA, 538 bp, Homo sapiens
  misc_feature: GZ8MTXP02JYNDN.10.77.G11.1.454.CMB.2.raw
  modified_base (504)..(504): a, c, t, g, unknown or other
  modified_base (512)..(538): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtatggtccgggcgggggggcaagtggacgtcgtggggccgaagggaccacggtcaccgtctcctcacgccctaccaccgaaacgggcccacgtccggtccttcccccgtcggccctacccctccctaccaaacgtacgccaccgtcccggtcgggggccacgacggccggccccgtggggccgtcgcccgtggtaccgaagggtaccttacccttcccgaactactacgtcgcgtaggacggcggggtacgtgggaccaagggccganacgtaggnnnnnnnnnnnnnnnnnnnnnnnnnnn

SEQ ID NO: 363824 - DNA, 513 bp, Homo sapiens
  misc_feature: GZ8MTXP02HUB74.10.77.G11.1.454.CMB.2.raw
  modified_base (202)..(202): a, c, t, g, unknown or other
  modified_base (241)..(241): a, c, t, g, unknown or other
  modified_base (308)..(308): a, c, t, g, unknown or other
  modified_base (353)..(353): a, c, t, g, unknown or other
  modified_base (489)..(489): a, c, t, g, unknown or other
tcagcatagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgctccaggggaaanagccaccctctcctgcagggccagtcagagtcttagganctccttagccttggtatcaacagaaacctggccaggctccaggctcctcatctatgatgcatccaanagggccactggcatcccagccagttcagtgcagtgggtctgggangcttacactctcaccatcagcagactagagcctgaagtatttgactagtttattactgtcaggtcagtcgtagacacgtggccgtggacgttcggacgaacgggacaaaaggtggaacagtacaacgcgaatcggngacgtcgacacacttcgtagttcc

SEQ ID NO: 363825 - DNA, 515 bp, Homo sapiens
  misc_feature: GZ8MTXP02IQULP.10.77.G11.1.454.CMB.2.raw
  modified_base (287)..(287): a, c, t, g, unknown or other
  modified_base (491)..(515): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctacaaatgaacagcctgagagccgacgacacggccgtatattactgtgacgaaagatacgtggacacatgtatgggtccggcggggggggcaagtggacgtcgtggggaccgaagggaccncggtcacccgtctcctcacgccctcccaccgacgggccccacgtccggtccccttccccccgtggccctacccctccctaccaagacgccacctcgtcggggcacgcgccggcctgggctcgccgtggtacgacgtacctaccttacccactactagtcgtactggacggcggggtctcggggcgaaacgggcgacctagaggnnnnnnnnnnnnnnnnnnnnnnnnn

SEQ ID NO: 363826 - DNA, 574 bp, Homo sapiens
  misc_feature: GZ8MTXP02IFBAV.10.77.G11.1.454.CMB.2.raw
  modified_base (341)..(341): a, c, t, g, unknown or other
  modified_base (521)..(521): a, c, t, g, unknown or other
  modified_base (532)..(532): a, c, t, g, unknown or other
  modified_base (534)..(535): a, c, t, g, unknown or other
  modified_base (537)..(539): a, c, t, g, unknown or other
  modified_base (541)..(541): a, c, t, g, unknown or other
  modified_base (543)..(543): a, c, t, g, unknown or other
  modified_base (546)..(546): a, c, t, g, unknown or other
  modified_base (548)..(548): a, c, t, g, unknown or other
  modified_base (557)..(557): a, c, t, g, unknown or other
  modified_base (559)..(561): a, c, t, g, unknown or other
  modified_base (563)..(564): a, c, t, g, unknown or other
  modified_base (566)..(566): a, c, t, g, unknown or other
  modified_base (568)..(568): a, c, t, g, unknown or other
  modified_base (572)..(573): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacaacgttggatctgcaaatgaacagcctgagagccgacgacacggccgtatattactgtgacggaaagatacgtggacacatgtatggtccggcggggggcaagtggacgtcgtgggccgaaggaccacggtcaccgtctcctcacgccctccaccgaacggcccacgtaccggtccttcccccgngcccaccctccctccaaagacgccaccgtccggtcggggcacgacggccggcccgtgggccgtcgccgtcggtaccaaacggtactacccgttacccctaaaccttactagtcggtacgttggaacggcccggggttcgtacgggacgaaacgggccggtaaccaggttaaacgtcgcgngacgagacagngnngnnngngngcngngcacgcacncnnngnncncncgcnng

SEQ ID NO: 363827 - DNA, 502 bp, Homo sapiens
  misc_feature: GZ8MTXP02JRJC1.10.77.G11.1.454.CMB.2.raw
  modified_base (302)..(302): a, c, t, g, unknown or other
  modified_base (476)..(502): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccggcggggggggcaagtggacgtcgtggggccaagggaccacggtcaccggtctcctacncgcctcccaaccgaacgggccccagtccggtaccttccccccgtggcccaccccgtcctacccgaaagacgcacctcccgtcggggccacgacgccggccgtgggctgcctggtacacggtactaccgttcccattactatcgctgacgcggcctggacgaaggcgacaagtgnnnnnnnnnnnnnnnnnnnnnnnnnnn

SEQ ID NO: 363828 - DNA, 494 bp, Homo sapiens
  misc_feature: GZ8MTXP02JZDJL.10.77.G11.1.454.CMB.2.raw
  modified_base (473)..(494): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtggtccggcgggggggcaagtggacgtcgtggggccaagggaccacggtcaccgtctcctcacgccctccaccgaacgggccccagtccggtccttcccccgtggcccacccctcctccaagacgcacctccgtcggggcacacggcgcccgttgggcctcgaccgtggtacaacggtacctaccgttcccactacctatcgctaggacgcgggcgtggacaaggcgcaagtgnnnnnnnnnnnnnnnnnnnnnn

SEQ ID NO: 363829 - DNA, 528 bp, Homo sapiens
  misc_feature: GZ8MTXP02IG5GR.10.77.G11.1.454.CMB.2.raw
  modified_base (304)..(304): a, c, t, g, unknown or other
  modified_base (345)..(345): a, c, t, g, unknown or other
  modified_base (493)..(495): a, c, t, g, unknown or other
  modified_base (497)..(499): a, c, t, g, unknown or other
  modified_base (502)..(524): a, c, t, g, unknown or other
  modified_base (526)..(528): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagacaattccaagaactacgttggatctgacaaatgaacagcctgagagccgacgacgacggccgtatattactgtgacgaaagatacgtggacacatgtatggtccggcggggggacaagtggacggtcgtgggccgaaagggccacggtcaccgtctcctnacgcctccaccgaacggcccagtcggtctcccccgtggccnccctcctaccaagtacgccacctccgtggggccacacggccggcccgtgggcctcgccgtggtacaacgggtacctactttccccacttacacgttagccgtaggacggccggggcgtacgggacgaaacgggcgaccgaagttaggnnngnnncgnnnnnnnnnnnnnnnnnnnnnnncnnn

SEQ ID NO: 363830 - DNA, 531 bp, Homo sapiens
  misc_feature: GZ8MTXP02HLYOO.10.77.G11.1.454.CMB.2.raw
  modified_base (315)..(315): a, c, t, g, unknown or other
  modified_base (342)..(342): a, c, t, g, unknown or other
  modified_base (418)..(418): a, c, t, g, unknown or other
  modified_base (499)..(531): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgacgaaagatacgtggacacatgtagtgggtccgggcgggggggacaaagtgggaacgtcgtggggccaaaggggaccacggtccaaccgtccgtaccccncgaccgtcctaccaaccggacggcccncgtccggtccctccccgtcgaccctaccctccaccaacgacacctccgtccggcggggacacgacggccggtccgngggccgtcgcgtacgtacgaacgtacctacctacccactactatcgcgtacggcggcggagtcggacgacgcgtacagtannnnnnnnnnnnnnnnnnnnnnnnnnnnnnnnn

SEQ ID NO: 363831 - DNA, 499 bp, Homo sapiens
  misc_feature: GZ8MTXP02IQ7QN.10.77.G11.1.454.CMB.2.raw
  modified_base (472)..(499): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggcctatattactgtgcgaaagatacgtggacacatgtatggtccggcgggggggcaagtggacgtcgtggggccaagggccacggcaccgtctcctcacgcctccaccgaacgggccccacgtccggtcctttccccccgcggtcccacccctccctccaaacgacgccacctccgtcgggggcacgacgcggcccgtgggctcgcctggccaagggcctacttcccacgtactaactcgctgacggcgggctcgggcgaaggcgacagtacgnnnnnnnnnnnnnnnnnnnnnnnnnnnn

SEQ ID NO: 363832 - DNA, 518 bp, Homo sapiens
  misc_feature: GZ8MTXP02HSRQA.10.77.G11.1.454.CMB.2.raw
  modified_base (186)..(186): a, c, t, g, unknown or other
  modified_base (292)..(292): a, c, t, g, unknown or other
  modified_base (397)..(397): a, c, t, g, unknown or other
  modified_base (460)..(460): a, c, t, g, unknown or other
  modified_base (472)..(472): a, c, t, g, unknown or other
  modified_base (481)..(481): a, c, t, g, unknown or other
  modified_base (484)..(484): a, c, t, g, unknown or other
  modified_base (486)..(518): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagacaattccaagaacacgttggatctgcaatgaacagcctgagngccgacgacacggccgtatattactgtgacgaaagattaaccgggtgacacatgtatggtccgggcgggggggacaatggacgtcgtggggaccgtaacgggaccncggtcaccggtctccgtcagcctccaaccggtacggccagtccggtcctccccccgttaggccctaccccgtcctaccgaagtacgccaccgtcgtcggggcacnggtcggccccgttgggcctgacgtcgtagaacggtactaccttcccgacttacctatcgtcgnggacgcggtcgnggacgagcntanannnnnnnnnnnnnnnnnnnnnnnnnnnnnnnnn

SEQ ID NO: 363833 - DNA, 531 bp, Homo sapiens
  misc_feature: GZ8MTXP02HCU4I.10.77.G11.1.454.CMB.2.raw
  modified_base (505)..(531): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtagtggtccggcggggggggcaagtggacgtcgtggggccaaagggaccacggtcaccgtctcctcagccctccaccaacgggccccatccggtccttaccccccgtggcccaccccttccacccaaagacgccaccgtcccgtcgggggcacgaacggccggcccgtggggctcgccgttcgggtaccaaagggtacctaccttacccccaacttacctaaagtcgcgttaggacgccggggctagggacccgaaaggccggcagtagnnnnnnnnnnnnnnnnnnnnnnnnnnn

SEQ ID NO: 363834 - DNA, 578 bp, Homo sapiens
  misc_feature: GZ8MTXP02JRQWB.10.77.G11.1.454.CMB.2.raw
  modified_base (544)..(544): a, c, t, g, unknown or other
  modified_base (546)..(553): a, c, t, g, unknown or other
  modified_base (555)..(578): a, c, t, g, unknown or other
tcagcatagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgggcgggggggacaagtggacgtcgtggggccaaggggaccacggacaccgtcgtcctcacgcctccaccaacgggcccaagtccggtcctttccccccgtggcccctacccttcccgtacccaaacgtaaccaccgtccggtccggggaccacgaccggcggtaccccgtggggacctcggccgttacgggtaccgaaaaccgggtccttaaccctttacccccaacgttaaccgttaacgttcggccctaggacgggtccggggtactcggggacgaaacgggtcgaccgtaaggtagngnnnnnnnnannnnnnnnnnnnnnnnnnnnnnnn

SEQ ID NO: 363835 - DNA, 721 bp, Homo sapiens
  misc_feature: GZ8MTXP02GNUN1.10.77.G11.1.454.CMB.2.raw
  modified_base (237)..(237): a, c, t, g, unknown or other
  modified_base (248)..(248): a, c, t, g, unknown or other
tcagcatagtagtgcacgaccggtgctcgatttagctagtcactcaagggaaaggggggaggaactgctcagttaggacccagagggaaccatggaagccccagctcagcttctcttcctcctgctactctggctcccagattccacggagaagttgtgttgacacagtctccagccacctgtctttggtctccgaaggggaagcgccaccctctcctagcacgggccagtcaaggnttacgttaggngtcctaccttagcctggtactacaacaacgaaacgtcggcacggctcccaggtctcctcactacttatcgaatcgtcaactaccaaaccgacggggaccacgtcgggacactcccgaggccgaacggtttacgacggttggaacgtgggttcggggttacgtggggaacacggggttaaccttactaccgtacccttaccgaaactaactacgagtaacgaaacgtaacgtaacgacgtaccgtagtaagttaatttacgtatttaacgtttacgttaacgtacgtacgtacggtactaggtacggtacgaacgtaaccgtcgggtacccggtacgggttaaccggttaaccggtaaccggaaaacgggtaaaaccgtaaacgggtaaacggtaaacgtaaacgacgtaaaccggaacggttaacgttacggaacggtacgtacgtactaccgtacttacgtttacgtttacg

SEQ ID NO: 363836 - DNA, 562 bp, Homo sapiens
  misc_feature: GZ8MTXP02FZ9P1.10.77.G11.1.454.CMB.2.raw
  modified_base (260)..(260): a, c, t, g, unknown or other
  modified_base (527)..(527): a, c, t, g, unknown or other
  modified_base (529)..(533): a, c, t, g, unknown or other
  modified_base (535)..(562): a, c, t, g, unknown or other
tcagcatagtagtgcacgaccggtgctcgatttagctagtcactcgaagggaaaggggctggagtgggtctcaggtattagtggtagtggtgatggcacatactacgcagactccgtgaagggccggttcagcatctccagagacaattccaagaacacgttggatctgcaaatgaacagcctgagacgccgacgacgacggccgtatattactgtgacgaaagatacggtgacacatgtagtggtccggggcggggggnaagtggcgtcgtcgggacgaacggaccgacggtcaccgtctcccgtacacgtccctaaccgaccgaacgggcccagtccggtaccctccccgtggaccctacccctcgtacccgaaagacgcctaaccgtcgggtcggggaccaacgcgcccggtcccgtgggcctacgccgttacgggaccaacgggtaaccttacccttaccctaatacgttaagcgtagtacggaacggccggctaggggaacccaaaggggcccaggttaaangnnnnnannnnnnnnnnnnnnnnnnnnnnnnnnnn

SEQ ID NO: 363837 - DNA, 520 bp, Homo sapiens
  misc_feature: GZ8MTXP02JFTM0.10.77.G11.1.454.CMB.2.raw
  modified_base (349)..(349): a, c, t, g, unknown or other
  modified_base (373)..(373): a, c, t, g, unknown or other
  modified_base (502)..(520): a, c, t, g, unknown or other
tcagcatagtagtgcacgaccggtgctcgatttagctagtcactcaaggggaaaggggctggagtgggtctcaggtattagtggtagtggtgatggcacatactacgcagactccgtgaagggccggttcagcatctccagagacaattccaagaacacgttggatctgacaaatgaacagcctgagagccgacgacacggccgtatattactgtgacgaaagatacgtggaacacatgtagtcgggtccggggcggggggcaagtcggacgtcgtggggccaagggccacggtccaccgtctcctcacgccctccaccgaacgggccccagtccggtccttcccccgnggcccctacccctcctacccagcnccacctccggtggggccacgcggccggcccgtgggctcggccgtcgggtacaacggtaccttaccctacccctaacgttctacgtcgacgggcggaccggggtctcgggaccgaaggccgacagtacgnnnnnnnnnnnnnnnnnnn

SEQ ID NO: 363838 - DNA, 247 bp, Homo sapiens
  misc_feature: GZ8MTXP01C2N3H.13.86.H09.1.454.CMB.2.raw
  modified_base (247)..(247): a, c, t, g, unknown or other
tcagtcacgtactacacgaccggtgctcgatttagtgctatagacttgggtttggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccacctcctctagtacgtgactgagcgggctggcaaggcgcatagn

SEQ ID NO: 363839 - DNA, 556 bp, Homo sapiens
  misc_feature: GZ8MTXP01EIYH5.13.86.H09.1.454.CMB.2.raw
  modified_base (350)..(350): a, c, t, g, unknown or other
  modified_base (358)..(358): a, c, t, g, unknown or other
  modified_base (365)..(365): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtgtgcacaaagttcgcanagaacttnaaagacngggtcaaccatagacccacgggacacgtccatacaaacacagcctaacataggaactggagacgacctaaagatctagaacgacacggtccgtttattagttcgtgactaaataaagaattaagaacttaaacgattgtatttggattagttggtaaggggccaaaggggacacgttgaagttcctaaccg

SEQ ID NO: 363840 - DNA, 510 bp, Homo sapiens
  misc_feature: GZ8MTXP01DLXHO.13.86.H09.1.454.CMB.2.raw
  modified_base (429)..(429): a, c, t, g, unknown or other
  modified_base (439)..(439): a, c, t, g, unknown or other
  modified_base (498)..(498): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatgggatcgagcccttaacaacggaaacacagactatggacaagaacctcgagggcagatcacatgacgacagacacatacaacgaacacagcctacatagggagtgggaaggngacctagganatatagacgacacggtcgtgtattaatgttgcgagagtggagttggcgaagtggaatangactaattctaa

SEQ ID NO: 363841 - DNA, 561 bp, Homo sapiens
  misc_feature: GZ8MTXP01AS4DF.13.86.H09.1.454.CMB.2.raw
  modified_base (318)..(318): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttaagaacggaacacagactagnggacagaacctcaggcagatcacaatgaacgacagacacataacacgaaacacagacctaacagtagggaggtaggagggagcccgtaggaagaatagtacggaacggaacgaccggggtccgttagttaagttaagttggtagacggaggtaggtaggaggtgggcaggttggaattagtacgaacttaaagttacttactaattacaagtgggtacgttacgtaaggggaaccgaaagggg

SEQ ID NO: 363842 - DNA, 505 bp, Homo sapiens
  misc_feature: GZ8MTXP01DEY45.13.86.H09.1.454.CMB.2.raw
  modified_base (327)..(327): a, c, t, g, unknown or other
  modified_base (398)..(398): a, c, t, g, unknown or other
  modified_base (440)..(440): a, c, t, g, unknown or other
  modified_base (475)..(475): a, c, t, g, unknown or other
tcagtcacgtactacacgaccggtgctcgatttagtgctatagacttgggtttggggacccaaaaccacacccctccttgggagaatcccctagatcacagctcctcaccatggactggacctggagcatcctttcttggtggcagcagcaacaggtgcccactcccaggttcagctggtgcagtctgcagctgaggtgagaagcctggggcctcagtgaagatctcctgcaaggcttctggttacacctttagcagctatcttatcagctgggtgcgacaggcccctggacgaggactcgagtggatgggatggatcagcccttanaacggaacacagactatggacagaaaccctcaagggcagattcaccatgacgacagacacatacagaaacncagcctacatggagtgaggggagcgtagagatagtgacgacncggtccgtgtattatgtgcgtagagtggagttggnaggtggatgtcgattaattaacaacgttaa

SEQ ID NO: 363843 - DNA, 541 bp, Homo sapiens
  misc_feature: GZ8MTXP01D7ELM.13.86.H09.1.454.CMB.2.raw
  modified_base (413)..(413): a, c, t, g, unknown or other
  modified_base (432)..(432): a, c, t, g, unknown or other
  modified_base (448)..(448): a, c, t, g, unknown or other
  modified_base (460)..(460): a, c, t, g, unknown or other
  modified_base (476)..(476): a, c, t, g, unknown or other
  modified_base (485)..(485): a, c, t, g, unknown or other
  modified_base (504)..(504): a, c, t, g, unknown or other
  modified_base (522)..(522): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctgaagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtgcgacaggccccctggacgaggactcgagtggatgggatggatcgacgcccttaacgaaacggaaacacgaaggactaagtggaacagaaaaccctccaaggggcagacttcgaccatgaacgacagacactanacaacgaacacagcccaanatggaggtgagggganccgtgaagatangacgacacggctagtnttatggtgnggagagtagggagttgggnaggtggataagaccgaanaaacttaacgttaattaaa

SEQ ID NO: 363844 - DNA, 683 bp, Homo sapiens
  misc_feature: GZ8MTXP01BJFJX.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgagaagctggggcctcagtgaagatctcctgcaaggtcttctggttacacctttagcagtctatcttatcagctgggtgcgacacggcccctggacgaggctcgagtggagtgggatggatcgacgtcccttaacgaaacggtaaacacgaacggtacctaagtacgggaacaacggaaacccttaccggaacggggaccaacgggtaacttacccaacccagttacggaaccgaacgaacggaaccaacgaactaaaccgaaaccggaaaaccaacccgaacggaccccttaaaccgaacgttacggggtaaacggtagggaacggggggaacgtacccgttagaaacggtaagtacgttacggaaccgaaccgacggtaccgtagttaagtttaagttggtagacggtagaggtaggtaggttcggcgttagggtaagtagttaacgtcggtaaaccttaaatttcccggttaactttaag

SEQ ID NO: 363845 - DNA, 498 bp, Homo sapiens
  misc_feature: GZ8MTXP01B1M8U.13.86.H09.1.454.CMB.2.raw
  modified_base (329)..(329): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
  modified_base (474)..(474): a, c, t, g, unknown or other
  modified_base (476)..(476): a, c, t, g, unknown or other
  modified_base (478)..(478): a, c, t, g, unknown or other
  modified_base (480)..(480): a, c, t, g, unknown or other
  modified_base (483)..(484): a, c, t, g, unknown or other
  modified_base (495)..(495): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctatcagctgggtgcgacaggcccctggacgaggactcgagtggatgggatggatcagcccttanaacggaacacagactatggacagaaacctcaagggcagatcaccatgacgacagacacatacacgaacacagcctacataggagtgaggggagcctgagatatgacgacacggtccgtgtattatgtgngngngtggagttgggngngngngtnnattataacttntaa

SEQ ID NO: 363846 - DNA, 250 bp, Homo sapiens
  misc_feature: GZ8MTXP01EL3MS.13.86.H09.1.454.CMB.2.raw
  modified_base (249)..(250): a, c, t, g, unknown or other
tcagtcacgtactacacgaccggtgctcgatttagtgctatagacttgggtttgggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccgccctcctctagtacgtgactgagcgggctggcaaggcgcatagnn

SEQ ID NO: 363847 - DNA, 521 bp, Homo sapiens
  misc_feature: GZ8MTXP01D5VW1.13.86.H09.1.454.CMB.2.raw
  modified_base (382)..(382): a, c, t, g, unknown or other
  modified_base (393)..(393): a, c, t, g, unknown or other
  modified_base (471)..(471): a, c, t, g, unknown or other
  modified_base (477)..(477): a, c, t, g, unknown or other
  modified_base (501)..(501): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcatctgaggtgaagaagcctggggcctcagtgaagatctcctgcaaggcttctggttacacctttagcagctatcttatcagctgggtgcgacacggcccctggacgaggactcgagtggatgggatgggatcgagccctaacgaacggaaacacagactatggacaagaacctcgagggcagatcacatnacgacagacanatacaacgaacacacgacctacagtaggaggtggaggagcctagagatagtgaacgacacgggccgtgtattaattgngcgagnggtggagttggctaaggtggaatnacgaactaatttaacgtaac

SEQ ID NO: 363848 - DNA, 519 bp, Homo sapiens
  misc_feature: GZ8MTXP01AMI0T.13.86.H09.1.454.CMB.2.raw
  modified_base (270)..(270): a, c, t, g, unknown or other
  modified_base (333)..(333): a, c, t, g, unknown or other
  modified_base (351)..(351): a, c, t, g, unknown or other
  modified_base (385)..(385): a, c, t, g, unknown or other
  modified_base (410)..(410): a, c, t, g, unknown or other
  modified_base (465)..(465): a, c, t, g, unknown or other
  modified_base (469)..(469): a, c, t, g, unknown or other
  modified_base (496)..(496): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttancagctgggtgcgacacggcccctggacgaggactcggagtggatgggatggatcagccctaanaacggaacacagactagnggacaagaacctcgagggcagatcacatgacganagacacatacacgaacacagcctanatgggagtgggaggacgctagagatagtgacgactacggctgtataagtgttcgngagngtggagttggagtaaggtgaattaacncggttaaactaatttaacgtaac

SEQ ID NO: 363849 - DNA, 250 bp, Homo sapiens
  misc_feature: GZ8MTXP01CPTTU.13.86.H09.1.454.CMB.2.raw
  modified_base (248)..(250): a, c, t, g, unknown or other
tcagtcacgtactacacgaccggtgctcgatttagtgctatagacttgggtttgggggtgtggtggtctccactcccgccttgacgaggccgactattactgcggaacatgggatagcagcctgagtttgggtgtcttcggcggagggaccaagctgaccgtccttcgtcagcccaaggctgccccctggtcactctcgttcccacctcctctagtacgtgactgagcgggctggcaaggcgcatagnnn

SEQ ID NO: 363850 - DNA, 601 bp, Homo sapiens
  misc_feature: GZ8MTXP01BOYDN.13.86.H09.1.454.CMB.2.raw
  modified_base (447)..(447): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctgagtgaagatctcctgacaaggtcttcgtggttacacctttagcagtctatctatcgagcgtgggtcgacgacgacggccccgtggacgaggactcggagtggagtgggatggatcgacgtaccttaacaaacggaaacacgagactagacggacaacgaaaccctacgaacgggcaaagacttaccaacctagtacgaacgacaacgacaacataacaacgaaacacganacctaagagtggaagtagaggggacgcgtagaacgtatgacgacgaaccgacgtccggttattaagttgttggtaggaggtaggaggtgggtaggttgggcgttagggtaagagttaacgtaacgtaacttaaacgtttaacttaacgtttaag

SEQ ID NO: 363851 - DNA, 629 bp, Homo sapiens
  misc_feature: GZ8MTXP01BV17U.13.86.H09.1.454.CMB.2.raw
  modified_base (215)..(215): a, c, t, g, unknown or other
  modified_base (223)..(223): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagctgggcctnagtgaagntctctgcaaggtcttcgtaggttaccactttagcagtctatctatcagcgtgggtgcgacgacggcccctggacgaggactcggagtggagtgggagtggatcgacgtcccttaaacgaaacggaaacacgacgactagtacggaaccaacgaaaccctccggaagggacaaaggtacttaccaactagtacggaaacaacaagaacaacaactaaccgaaacgaaaccacgaacgtaccaacgagtaggaagggtacggaacggggacgtccgtaagaagtaatacgtacggaacgaccgacggtccgttagttattaggtggtacgacggtaggttaggtagggaaggttggagttagggtaaggaattaacgtacgaaacgttaaatttcgttaacgtttaag

SEQ ID NO: 363852 - DNA, 629 bp, Homo sapiens
  misc_feature: GZ8MTXP01CZAC5.13.86.H09.1.454.CMB.2.raw
  modified_base (218)..(218): a, c, t, g, unknown or other
  modified_base (271)..(271): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatctcctgcaaggcttcgtggttacacctttagcagtctatcttancagcgtgggtgcgacgcggcccctggacgaggacgtcgagtggagtgggatgggatccgacgtacccttaacgaaacggaaacaccaagacgtagtacggaaccaaacggaaccctccggaagggacaaggtacttaccaaccgtagtacgaacgaacaacgaacaacaactaaccgaaacgaaacacacgacctaacgagtagggaggtaggggacgggacgccgtaggaagtatacgtaggaacgaaccggtacggtaccgttagttagttaagttggaggacgggaggtagggtgggaggttgggacgtaagggtaggtaactaacgtacgttaaactaaacttaaccgttaaag

SEQ ID NO: 363853 - DNA, 589 bp, Homo sapiens
  misc_feature: GZ8MTXP01CZAYB.13.86.H09.1.454.CMB.2.raw
  modified_base (218)..(218): a, c, t, g, unknown or other
  modified_base (281)..(281): a, c, t, g, unknown or other
  modified_base (433)..(433): a, c, t, g, unknown or other
  modified_base (484)..(484): a, c, t, g, unknown or other
  modified_base (529)..(529): a, c, t, g, unknown or other
  modified_base (536)..(536): a, c, t, g, unknown or other
  modified_base (549)..(549): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctnagtgaagatctcctgcaaggcttcgtggttacacctttagcagctatcttatcagcgtgggtncgacacggcccctggacgaggactcggagtggagtgggatggatcgacgtacccttaacgaaacggaaacacaaggactagtaggaacaacgaaaaccctccgaagggccaaggtacttaccaaccatacgaaaccgacaacgaacaacaanaaccaacgaaaccaacacgacctaacgagagggaaggtaggaagggggacnccgtagaggtatagcgaacgacgacggtcgtagttattggtgtgnggtaagnggtaggagttggnaggtggactaagtacgaacttaaattccgttaagtttaag

SEQ ID NO: 363854 - DNA, 541 bp, Homo sapiens
  misc_feature: GZ8MTXP01CG0PG.13.86.H09.1.454.CMB.2.raw
  modified_base (218)..(218): a, c, t, g, unknown or other
  modified_base (388)..(388): a, c, t, g, unknown or other
  modified_base (481)..(481): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctnagtgaagatctcctgcaaggcttctggttacacctttagcagctatcttatcagctgggtgcgacaggcccctggacgaggactcgagtggatgggatgggatcgagccttaacaacggaacaccagactagtggacaacgaacctcgaggggcagatcaccatgacganagacacatacaacgaacacagacctacagtggaggtggaggacgccgtagagatagtacggaacgacgacggtccgtagtattaagtgttcgngaggaggtgggagttggcgtaaggtgggtaattagtacggaactaaagtttaaccgtaac

SEQ ID NO: 363855 - DNA, 251 bp, Homo sapiens
  misc_feature: GZ8MTXP01CCA90.13.86.H09.1.454.CMB.2.raw
  modified_base (249)..(251): a, c, t, g, unknown or other
tcagtcacgtactacacgaccggtgctcgatttagtgctatagacttgggtttggggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccgcctcctctagtacgtgactgagcgggctggcaaggcgcatagnnn

SEQ ID NO: 363856 - DNA, 556 bp, Homo sapiens
  misc_feature: GZ8MTXP01C0RXM.13.86.H09.1.454.CMB.2.raw
  modified_base (506)..(506): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggtacactttagcagctatcttatcagctgggtgcgacacggcccctggacgaggactcgagtggatgggatggatcgagtacccttaacgaaacggaaacacacgactagtggaacacgaaaccctcgaagggcagacttacaccatacgacacagacacatacacgaacacagacctacagtggagtggaggggacgcgtagagatagtcgacgacgacggtcgtagtattagtggtgcggagaggtagggaggttcgggnttaggtggataacgtacggtaacttaaacgtttaaccgttaacgtttaag

SEQ ID NO: 363857 - DNA, 578 bp, Homo sapiens
  misc_feature: GZ8MTXP01AHJW8.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagcgtgggtgcgacgacggcccctggacgaggactcgagtggatgggatggatcagcccttaacgaacggaaacacaacgactagtcggacacgaaaccctccgaagggcagactcacatcgacacagacacatacacgaacacagaccctaagagtagggagtaggacggggacgccgtagacggatagtcgaccgacgacgggtccgtagtacttgttggtcggttaggaggttaggtagggaagggttgggcgttagggtaagggataacgtacggaacttaaaactttaaccttaacgtttaag

SEQ ID NO: 363858 - DNA, 517 bp, Homo sapiens
  misc_feature: GZ8MTXP01A1A9R.13.86.H09.1.454.CMB.2.raw
  modified_base (218)..(218): a, c, t, g, unknown or other
  modified_base (338)..(338): a, c, t, g, unknown or other
  modified_base (357)..(357): a, c, t, g, unknown or other
  modified_base (379)..(379): a, c, t, g, unknown or other
  modified_base (385)..(385): a, c, t, g, unknown or other
  modified_base (424)..(424): a, c, t, g, unknown or other
  modified_base (454)..(454): a, c, t, g, unknown or other
  modified_base (477)..(477): a, c, t, g, unknown or other
  modified_base (479)..(479): a, c, t, g, unknown or other
  modified_base (483)..(483): a, c, t, g, unknown or other
  modified_base (490)..(490): a, c, t, g, unknown or other
  modified_base (492)..(492): a, c, t, g, unknown or other
  modified_base (494)..(494): a, c, t, g, unknown or other
  modified_base (504)..(504): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctnagtgaagatctcctgcaaggcttcgtggttacacctttagcagctatcttatcagcgtgggtgcgacacggccccctggacgaggactcggagtggatggggatgggatcgagccctaanaacggaacaccagactagnggacaagaacctcgaggcagtntcacanagacgacaagacacataacaacgaaacacaacgcctaanagtaggaggtaggggagagcctagagatangacgcaggctatgtaatattggngngagnggttggngngngtagtgatanataacgttaataa

SEQ ID NO: 363859 - DNA, 632 bp, Homo sapiens
  misc_feature: GZ8MTXP01D7VXF.13.86.H09.1.454.CMB.2.raw
  modified_base (272)..(272): a, c, t, g, unknown or other
  modified_base (582)..(582): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagaagcctggggcctcagtgaagatctcctgcaaggtcttctggttacacctttagcagctatcttancagctgggtgacgacgacggccccgtggacgaggactcggaggtggagtggggatggatacgacgtcccttaacgaacggaaacacacgactagtaggaacacgaaaccctccgaagggacaagtacttccaaccgtagtacgaacaaccgaagaaccaactaactaaccaaaccgaaaaccaaccgaacgaccctaacgaagttaggggaaggtacggaagggggacgtaccgtaagagaatacgtacgaacgaacgtaccggtacgttagttaacgtttagtcggttgacggtaggaggtgggtaagnggttgttagtaaggtataagtaacgaattaaacttaacgttaactttaag

SEQ ID NO: 363860 - DNA, 789 bp, Homo sapiens
  misc_feature: GZ8MTXP01BVNL5.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctgggcctcagtgaagatctcctgcaggcttctggttacacctttagcagctatctatcagctgggtgcgacacggcccctggacgaggactcgagtggagtgggatggatcgacgtaccccttaacgaaacggaaacacgtaacgaacctagtacgggaaaccaacggaaaaaccccgttaccgaagggggacctaaacgggtaacctttacccgaaacccgtaagtacgggaaaccggaaaccaaacggaaaccaaaccgaacttaaacccgaaaccggaaaacccaaccgaaacgtaccccgttaaaccgaaggttacggggaaaggggttacgggaaacgggggaacggtcccggttaaaggaaacggtaaacgttaaggtaccgggaaaccggaacccgggtaaaccggggtacccggtttaaggttaaacgttttaggtttaagggtacgggttaccggggtaaggttaggggttaggggtaaggggtttcggggacggttaacggggttaaggggtaagttaacggttaaccggtaaaacttaaaaacgtttaaccctttaaagttttaaaaccg

SEQ ID NO: 363861 - DNA, 650 bp, Homo sapiens
  misc_feature: GZ8MTXP01CHN7J.13.86.H09.1.454.CMB.2.raw
  modified_base (275)..(275): a, c, t, g, unknown or other
  modified_base (314)..(314): a, c, t, g, unknown or other
  modified_base (562)..(562): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtgggctgagtgaagatctcctgcaaggtctttcgtggttactaccgtttagcagtctatcttancgagcgtggtgcgacgcggccccgtggacgaggactggngtaggagtcgggatgggactcgacgtacccttaaacgaaacggaaacaccgagtactaagtacggaacaaaccgaacccgtcgaagggactaaacgtactacgaacctagtacgaacgacagaaccaacaactaaccaacgaaaccacaacgaccctagaaggtgggaaggtaggggaaggacgtccgtaaggaagtaacgtacgtacggaaccgaacggtaccgggtcgttagttaattaaggttgnggtacggaagggtacggtgggttaggttcggacgggtaaggtggtaaacttacggtacgttaaacgtttaaacttaacggtttaaacg

SEQ ID NO: 363862 - DNA, 552 bp, Homo sapiens
  misc_feature: GZ8MTXP01B60HP.13.86.H09.1.454.CMB.2.raw
  modified_base (271)..(271): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctcagtgaagatctcctgcaaggtcttctggttacacctttagcagtctatcttancagctgggtgcgacgacggcccctggacgaggactcggagtggagtgggatggatcgagaccccttaagaacggaacaccgagactagtggacaacgaaccctcgagggcagacttcacatacgacgacagacacataacaacgaacacacgacctacgagtgggagtaggggaggacgccgtagacgatagagtaacgacgaccgggtctagttattaagttggcggcgaaggtggtggagttcggagtggtggaatcgtacgaataacgttcgttaacg

SEQ ID NO: 363863 - DNA, 567 bp, Homo sapiens
  misc_feature: GZ8MTXP01AM8TZ.13.86.H09.1.454.CMB.2.raw
  modified_base (273)..(273): a, c, t, g, unknown or other
  modified_base (288)..(288): a, c, t, g, unknown or other
  modified_base (395)..(395): a, c, t, g, unknown or other
  modified_base (401)..(401): a, c, t, g, unknown or other
  modified_base (434)..(434): a, c, t, g, unknown or other
  modified_base (501)..(501): a, c, t, g, unknown or other
  modified_base (518)..(518): a, c, t, g, unknown or other
tcagtcacgtactacacgaccggtgctcgatttagtgctatagacttgggtttggggcacccaaaaaccacacccctccttgggagaatcccctagatcacagctactcaccatggactggacctggagcatccttttcttggtggcagcagcaacaggtgcccactcccaggttcagctggtgcagtctgcagctgaggtgaagaagccgtggggcctcagtgaagatctcctgcaaggtcttctggttacacctttagcagtctatcttancagcgtggtgcgacncggcccctggaccgaggactcggagtgagtgggatggatcgacgtaccctaacgaaacggaacacgagactagtaggacaaacgaacctcgagggcagactacacancgacanacgacacaacgacaacgaacactacgacctaanagtacgggaggtgggaggtacgcgtaggagtatagacggacgacgtacggtcgtagtattaagttgngtacggagtaggtgggngttgggactaaggtaggaattacgtacgaacttaaacgttaacgttaac

SEQ ID NO: 363864 - DNA, 573 bp, Homo sapiens
  misc_feature: GZ8MTXP01BZIG2.13.86.H09.1.454.CMB.2.raw
  modified_base (272)..(272): a, c, t, g, unknown or other
  modified_base (366)..(366): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctgagtgaagatctcctgcaaggtcttcgtggttacacctttagcagctatcttancagcgtgggtcgcgacgacggccccgtggacgaggactcggaggtggaagtgggatggactcgacgtcccttaagaaacggaacacaggatagngaacaagaacctccgagggcaagactacaccagtcgaacgacaagacaacactaacaacgaactacacgacctagagtagggacggtggggaacggacgactaggaagatacgcgaacgacgtcggtaccgttagtagttgtggttggacgagtacgtgggcgttgggagtaaggtggaattacgacgttaacttaaagttcttaag

SEQ ID NO: 363865 - DNA, 534 bp, Homo sapiens
  misc_feature: GZ8MTXP01EXR2T.13.86.H09.1.454.CMB.2.raw
  modified_base (270)..(270): a, c, t, g, unknown or other
  modified_base (280)..(280): a, c, t, g, unknown or other
  modified_base (454)..(454): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttancagctgggtncgacaggcccctggacgaggactcggagtggagtggggatgggatcgagcccttaacgaaacggaaacacgagactagtggacaaagaaccctcgagggacagatcacatgacacagacacatacaacgacacagacctacagtgggagtagggaggtagccgtagagatacgngacgacgacggtccgtgttataagttggttggcgaggaggtgaggttggcgaaggtggaatagcgaactaaagttctaac

SEQ ID NO: 363866 - DNA, 601 bp, Homo sapiens
  misc_feature: GZ8MTXP01ANNIC.13.86.H09.1.454.CMB.2.raw
  modified_base (218)..(218): a, c, t, g, unknown or other
  modified_base (279)..(279): a, c, t, g, unknown or other
  modified_base (504)..(504): a, c, t, g, unknown or other
  modified_base (536)..(536): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctnagtgaagatctcctgcaaggcttcgtggttacactttagcagctatcttatcagctgggtncgacgacggccccgtggacgaggactcgaggtggagtgggatggatcgacgtacccttaacgaaacggaaacacgaacgactagtacggaacaacgaaaccctacgaacgggacaaggtacttaccgaacctagtacgaacgaacaacgaacaacaactaaccgaacgaaaccaacgacgaccctaacgagtaggaggtagacggggacgacgtagagtagtagngaacgacgacggtccgtagtagttgtggtagnggtaggaggttgggaggttggcgttaggtaaggataagacgaattaaagttaacgttaacttaag

SEQ ID NO: 363867 - DNA, 627 bp, Homo sapiens
  misc_feature: GZ8MTXP01AGZKP.13.86.H09.1.454.CMB.2.raw
  modified_base (186)..(186): a, c, t, g, unknown or other
  modified_base (265)..(265): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagagccgtgggcctnagtgaagatctcctgcaaggtctttcgtggttactacctttagcagtctatcttatcagcgtggtgcgacgcggcccgnggacgaggactcggaggtggagtgggatggatcgacgtacccctaacgaaacggaaacagagactagacggaacaacgaacctcgaggacagtactacaccaagtacgaacgaacaagaacacaactaacgaaacgaaaccacaacgaccctaagaggtagggaggtaggacggacgacgtagaacgtaagtacgacggaacggacgtacgggtccgttagttaagttagttgaggacggaggtgggtaggtaggtggaagtaggttaggtaagttaacgtacgtaaacttaaagtttacttaacttaagttacgtaagtacgggtacggttacgggtaacggggttaaccggtaaacgggg

SEQ ID NO: 363868 - DNA, 617 bp, Homo sapiens
  misc_feature: GZ8MTXP01ACJJ0.13.86.H09.1.454.CMB.2.raw
  modified_base (279)..(279): a, c, t, g, unknown or other
  modified_base (484)..(484): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtncgacaggcccctggacgaggactcgagtggatgggatggatcgagtcccttaacgaaacggaaacacgaacgacctagtaggaaccacgaaaacccttcccgaaggggcaggacttcaaccatgaacgacagacacactacaacgaaacactagacctaacgagtggggaaggtggaagggggacgccgtaggaaggaattacgnggaaccgacgacgggtccgttaggttattaagttggcgttacggaaggttaggttacggggaagttcgggcgaagggtgggtaattaacgtaaccggtaaaccttaaaatttaacccgttaacgttttaaacg

SEQ ID NO: 363869 - DNA, 665 bp, Homo sapiens
  misc_feature: GZ8MTXP01A7IYW.13.86.H09.1.454.CMB.2.raw
  modified_base (187)..(187): a, c, t, g, unknown or other
  modified_base (252)..(252): a, c, t, g, unknown or other
  modified_base (285)..(285): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagagccgtggggcctnagtgaagatctcttgcaaggtcttctggttacacctttagcagtctatcttatcagtcgtgggtncgacgacggccccgtggacgaggactcggaggnggagtgggtatggatcgacgtaccctaacgaaacggaacacgaagtactaagtcggaactaacgaacccgtcgaacggggccaaggtacttaccaacctaagtacgggaaccacgaaaccgaacaactaacaacgaaacgaaccaacacgtaccctaagagtagggaggtaggaacggacgaccgtaggaatagtagtacggaacgggaacggtacgggtccgttagtttaaacgttgttggtaggacggtaaggtaggtgggtaggtgggaagtaggttaggtaattaacgtaaccgtaaattaaacgtttcttaaacgttaacttacgtaaggtcgggtaacggtttacggggaacggggaacggtaaaacccggggg

SEQ ID NO: 363870 - DNA, 633 bp, Homo sapiens
  misc_feature: GZ8MTXP01BQ5UJ.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttcgtggttacactttagcagtctatctatcagctgggtgcgacgcggccccgtaggacgaggactcgagtggatgggatggatcgacgtccttaacgaacggaacacagactagtacggacacgaaaccctcgaagggctaagtacttacaaccgtagtacgaaaccgacaacgacaacgactaaaccgaaacgaaaccaaccgtacgtaccctaaacgaggtaacgggaagggtacgagggggtacgtaccgtaggaacggtattaacgacggaacgaacgtccgggtaccgttagttacgttaaggttggacggttacggaaggttggtagggaggttggacgttaggtaaggtataacgtaccggaattaaacttcgttaaaccttaag

SEQ ID NO: 363871 - DNA, 379 bp, Homo sapiens
  misc_feature: GZ8MTXP01BO913.13.86.H09.1.454.CMB.2.raw
  modified_base (374)..(379): a, c, t, g, unknown or other
tcagtcacgtactacacgaccggtgctcgatttagtgctatagacttgggtttgggggctgttcctgggacctgctggtaccaggaacagcccccaaactcctcattcttgacgataatcagcgaccctcagggattcctgcccgattctctggctccaagtctggcacgtcagccaccctgggcatcaccggactccagactgcggacgaggccgactattactgcggaacatgggatagcagcctgagtttgggtgtcttcggcggagggaccaagctgaccgtcttcgtcagcccaaggctgccccctggtcactctcgttcccgccctcctctagtacgtgactgagcgggctcggcaaggcgcataagnnnnnn

SEQ ID NO: 363872 - DNA, 548 bp, Homo sapiens
  misc_feature: GZ8MTXP01EYZFT.13.86.H09.1.454.CMB.2.raw
  modified_base (237)..(237): a, c, t, g, unknown or other
  modified_base (247)..(247): a, c, t, g, unknown or other
  modified_base (308)..(308): a, c, t, g, unknown or other
  modified_base (365)..(365): a, c, t, g, unknown or other
  modified_base (410)..(410): a, c, t, g, unknown or other
  modified_base (418)..(418): a, c, t, g, unknown or other
  modified_base (424)..(424): a, c, t, g, unknown or other
  modified_base (473)..(473): a, c, t, g, unknown or other
  modified_base (502)..(502): a, c, t, g, unknown or other
  modified_base (512)..(512): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagagcctggggcctcagtgaagatctcctgcaaggcttctggttacacctttagcagctatcttancagctgggtncgacacggcccctggacgaggactcgagtggatggatggatcagcccttagaaacggaacncaagactatggaacagaacctcgaggcagatcacaatacgaacacagtacacgtaanaccaacgaaaccacgtagaccctaagagtagggaggtagaggtanccgtaganagtagngaacgggactacgggtctaggtattagtgtggagtaggagtggagtggntaggttggattagacgaattaaacgtttnactaattagnttacggggattacggtaaggggaacgaaaacggggg

SEQ ID NO: 363873 - DNA, 555 bp, Homo sapiens
  misc_feature: GZ8MTXP01B95E9.13.86.H09.1.454.CMB.2.raw
  modified_base (265)..(265): a, c, t, g, unknown or other
  modified_base (377)..(377): a, c, t, g, unknown or other
  modified_base (394)..(394): a, c, t, g, unknown or other
  modified_base (410)..(410): a, c, t, g, unknown or other
  modified_base (421)..(421): a, c, t, g, unknown or other
  modified_base (445)..(445): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggtctttctggttacacctttagcagctatcttatcagctgggtcgcgacgacggccccnggacgaggactcgagtggagtgggatggatcaacgccccttaacgaaacggaaacacgagactagtcggacagaacctcgacggcagatccacaatcgaacgacagacacanaccacaacacagcctanagtggaggtagaggancgagagatagngacgacgacggtctagtatagtgngacgagtgtaggcgtggaactaggttagagttacgtacgtaattaaaactttcttaacttaattacgaagttacggggacgttacgggtaaggggaacccgtaaaggggg

SEQ ID NO: 363874 - DNA, 251 bp, Homo sapiens
  misc_feature: GZ8MTXP01DLU7V.13.86.H09.1.454.CMB.2.raw
  modified_base (250)..(251): a, c, t, g, unknown or other
tcagtcacgtactacacgaccggtgctcgatttagtgctatagacttgggtttggggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccgccctcctctagtacgtgactgagcgggctggcaaggcgcatagnn

SEQ ID NO: 363875 - DNA, 661 bp, Homo sapiens
  misc_feature: GZ8MTXP01BL10E.13.86.H09.1.454.CMB.2.raw
  modified_base (227)..(227): a, c, t, g, unknown or other
  modified_base (277)..(277): a, c, t, g, unknown or other
  modified_base (288)..(288): a, c, t, g, unknown or other
  modified_base (578)..(578): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagagccgtgggcctgagtgaagntctcctgacaaggtcttcgtaggttactacctttagctagtctatcttancagcgttgggngacgacgcggcccctggacgaggtactggaggtggagtgggagtggatcgacgtaccctaacgaaacggaaacaccgagtactagtacgaacaaacgaacccgtcgagggacagtactaccaacgatacgaccgacaacggaaccaacgtaacgtaaaccaaacccggaacaaccgaccggtaacctaaacgagtaagggacgggtaggggaacggtacgtaccgtaggaaagaagttacggacgaaaccggtacgtacccggggtaccttagttaacgtttaaggtggngggtaacggttaggtgggttaagggcggttaggcgtaagggtggtaagttaacgacgttaaaacttaacggttttaacctaag

SEQ ID NO: 363876 - DNA, 617 bp, Homo sapiens
  misc_feature: GZ8MTXP01EE41U.13.86.H09.1.454.CMB.2.raw
  modified_base (217)..(217): a, c, t, g, unknown or other
  modified_base (268)..(268): a, c, t, g, unknown or other
  modified_base (337)..(337): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctgggcctnagtgaagatctctgcaaggtcttctggttacacctttagcagctatcttancagctgggtgcgacgacggcccctggacgaggactcggagtggagtgggatggatcgacgtaccctaanaaacggaaacacagactagtacgacaaacgacctcgagggcagactcgacatgacgacagacacatacaacgaactacacgcctaacgatagggacggtaggggaagggacgtaccgtaggaaggtataacgtcggaaaccgaccgtaccggggtacccgttaggttaatttaacggttggttacggacggttaagggtacgggttaggggaaggttcgggaggtaaggtagggtaattacggtaccgttaaaacgttaaagttttaacccgtttaaaag

SEQ ID NO: 363877 - DNA, 498 bp, Homo sapiens
  misc_feature: GZ8MTXP01CPBYK.13.86.H09.1.454.CMB.2.raw
  modified_base (150)..(150): a, c, t, g, unknown or other
  modified_base (198)..(198): a, c, t, g, unknown or other
  modified_base (245)..(245): a, c, t, g, unknown or other
  modified_base (451)..(451): a, c, t, g, unknown or other
  modified_base (477)..(481): a, c, t, g, unknown or other
  modified_base (483)..(498): a, c, t, g, unknown or other
tcagtcacgtactacacgaccggtgctcgatttagtgctatagacttgggtttgggatggatcagcccttacaacggaaacacagactatggacagaacctccagggcagattcaccatgacgacagacacatacacgaacacagcctanatggaggtgaggagcctgagatatgacgacacggccgtgtattattgngcgagagtggagtggcaggtggatatcgaacaaattctactattacntggacgtcgtggggacgaaagggacgacggtcaccgttcgccagcctccaccgaacggcccagtccggtccttcccccgtggccacccctcctacccaagacgccacccgtcgtcgggggcaccgacggcggcccgtgggcctcggcccgtcgggtacaaacgggaccctacgttcctagggtacgtcgaccgtggacggcggggngtcgggacgaagggtcgcaagtaggnnnnngnnnnnnnnnnnnnnnn

SEQ ID NO: 363878 - DNA, 689 bp, Homo sapiens
  misc_feature: GZ8MTXP01D6IG1.13.86.H09.1.454.CMB.2.raw
  modified_base (218)..(218): a, c, t, g, unknown or other
  modified_base (637)..(637): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctnagtgaagatctcctgcaaggcttcgtggttacacctttagcagtctattcttatcagcgtgggtcgcgacgacggccccgtggacgaggctcgagtggagtgggatggatcgacgacccgttaacgaaacggaaacacgaacgacgtaagtacggaaccaacggaaaacccgttccgaaggggactaaacgggtacttaccaaccgtagtacgaaccgaacaacgacaacgaactaacaaaccgaaacaacgaacgtaccctaacgacggtagggaaagggtacggacgggggtaacgaccggttaaggaacgtaacgttaacggtaacggaaccggtaaccgtaccgggttaccggttagtttaaacgtttaggttaacggtacggacgggtaggttagggttacgggaggttacggngttaggttaaggtataacgtacgaaacgttaaatttaaccgttaagttaacg

SEQ ID NO: 363879 - DNA, 572 bp, Homo sapiens
  misc_feature: GZ8MTXP01BYOWC.13.86.H09.1.454.CMB.2.raw
  modified_base (217)..(217): a, c, t, g, unknown or other
  modified_base (283)..(283): a, c, t, g, unknown or other
  modified_base (438)..(438): a, c, t, g, unknown or other
  modified_base (459)..(459): a, c, t, g, unknown or other
  modified_base (462)..(462): a, c, t, g, unknown or other
  modified_base (480)..(480): a, c, t, g, unknown or other
  modified_base (513)..(513): a, c, t, g, unknown or other
  modified_base (529)..(529): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagcctgggcctnagtgaagatctccgtgacaaggtcttcgtggttactacctttagcagtctatctatcagcgtggtncgacacggccccgtaggacgaggactcgagtggagtgggactggatcgacgtacccgttaaacaaacggaaacaccgaagaccttaagacggaacaacggaaaccgttacccgaagggccaaagacttacaaccagacgaacgacagacaactanaacaacgaaacatagccaaanagnggagagaggacgcgaganatagagacgacgacgtacgtagtagtagtgtgngagaggtaggtgaggngagtaagtagtaagtactaacgttaacttaacgttaacgtaag

SEQ ID NO: 363880 - DNA, 602 bp, Homo sapiens
  misc_feature: GZ8MTXP01D9K3Q.13.86.H09.1.454.CMB.2.raw
  modified_base (216)..(216): a, c, t, g, unknown or other
  modified_base (268)..(268): a, c, t, g, unknown or other
tcagtcacgtactacacgaccggtgctcgatttagtgctatagacttgggtttgggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctgggcctnagtgaagatctcctgcaaggtcttctggttacacctttagcagctatcttancagctgggtgcgacgacggccccgtggacgaggactcggagtggagtgggatggatcgacgacccttaacgaaacggaacaccgagactagtcggaacaaacgaaccctcgaagggacagtactccaacagtacgaacgacagacaacaactaacaacgaacaacacgacctaacagtagggacggtaggggaaggacgaccgtagaagtaagtacgtaggaaccgacgtacgggtaccgttgttaattaagtggttggagttagtagggtgggaaggttgggacgtaaggtgggtaattagtacggttaaactaaacgtttaaccgtttaaag

SEQ ID NO: 363881 - DNA, 638 bp, Homo sapiens
  misc_feature: GZ8MTXP01DFG2Y.13.86.H09.1.454.CMB.2.raw
  modified_base (218)..(218): a, c, t, g, unknown or other
  modified_base (282)..(282): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatctcctgcaagggctttctggttaacacctttagcagctatcttatcagctgggtncgacacggccctggacgaggactcgagtggatgggatggatcgacgcccttaacgaaacggaaacaccgacgtactagtgaacctaaacgaacctcccggagggcaaagacttaccaacgagtacgaacgaactaacggaacaacaactaacaaacgaacacgtacgacctaacgagtgggaacggtagggacggacgtaccgtaggaagtacgtaacggtacgaaaccggtaccgtaccgggtacccgttaagttaatttaacggttggttaccggacggaaggtagggtgggaaggttggacgtaagggttaggaattaacgggtaacgaaaccttaaagtttaaccgtaaacg

SEQ ID NO: 363882 - DNA, 252 bp, Homo sapiens
  misc_feature: GZ8MTXP01AGL35.13.86.H09.1.454.CMB.2.raw
  modified_base (249)..(252): a, c, t, g, unknown or other
tcagtcacgtactacacgaccggtgctcgatttagtgctatagacttgggtttggggggtgtggtggtctccactcccgccttgacgaggccgactattactgcggaacatgggatagcagcctgagtttgggtgtcttcggcggagggaccaagctgaccgtccttcgtcagcccaaggctgccccctggtcactctgttcccgccctcctctagtacgtgactgagcgggctggcaaggcgcatagnnnn

SEQ ID NO: 363883 - DNA, 701 bp, Homo sapiens
  misc_feature: GZ8MTXP01EWFIG.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagcgtgggtgcgacgacggcccctggacgaggctcgaggtgatgggatggatcgacgtacccttaacgaaacggaaacacgaacggacttaaagtacgggaaccaaaccggtaaaaccccttaccggaagggggacccaaagggtacctttacccgaacccgtaagtacggaaacccgaacgaaacgaaccaaacgaactaaccgaaccgaaaccaaccaacggaccctaacgagttagggaagggtacggaacgggggaacgtcccggttaaggaacgtaagttacgtacggaacccggaacgaccgggttaccgtaggtttaactttaaggttcggttaggacgggtaagggttagggtggggtaaggttgggcgttaggtaagggaacttaagtacggaaacttaaactttaacgttaactttaaagg

SEQ ID NO: 363884 - DNA, 635 bp, Homo sapiens
  misc_feature: GZ8MTXP01A4C75.13.86.H09.1.454.CMB.2.raw
  modified_base (219)..(219): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtgggcctnagtgaagatctccgtgacaaggtcttcgtcggttacacctttagctagtctattcttatcagtcgtgggtcgaccggacgcgggtcccccgtaggaccggaagggtacctcgggaggtgggagtagggggatgggtactcgtaccgacccgttaacgaaacggaaactacccgagtaacttaggacgaacaaacgaacctccggaggccagtactcgaacagtacgacgactagacacaactaacgaaccaacaactacgacctacgagtagggacggtgggaaggacgtccgtagaagtagttcgacggaacgaccggtacggttacgttagttaagttgtttgacgggtagaaggtaggttcgggagttggacgttaaggggtactaattaaggcaaacgttaattaactaacg

SEQ ID NO: 363885 - DNA, 606 bp, Homo sapiens
  misc_feature: GZ8MTXP01BZI1O.13.86.H09.1.454.CMB.2.raw
  modified_base (218)..(218): a, c, t, g, unknown or other
  modified_base (270)..(270): a, c, t, g, unknown or other
  modified_base (393)..(393): a, c, t, g, unknown or other
  modified_base (401)..(401): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatctcctgcaaggtcttctggttacacctttagcagctatcttancagcgtgggtcgcgacacggcccctggacgaggactcgaggtggagtgggatggatcgacgtacccttaagaaacggaaacacagtacagtgacaaacgaacctcgagggcaagactcactanacgacganaacgacacaactaaccgaaacgaaacaccacggacctaacgaggtagggagggtaggggagggtaacgtccgtaggaagtagtacgtacggaaccgacgtacgggtccgttgttaacgttaagttggttcggaggaggtaggtgggacggttcgggagtaagggttggaatttacggacttaaacttaaaacgtttccgttaaac

SEQ ID NO: 363886 - DNA, 616 bp, Homo sapiens
  misc_feature: GZ8MTXP01CTZAQ.13.86.H09.1.454.CMB.2.raw
  modified_base (218)..(218): a, c, t, g, unknown or other
  modified_base (272)..(272): a, c, t, g, unknown or other
  modified_base (284)..(284): a, c, t, g, unknown or other
  modified_base (551)..(551): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctnagtgaagatctcctgcaaggtcttcgtggttacacctttagcagtctatcttancagtcgtgggtnacgacgcggcccctggacgaggctcgagtggagtggatggactcgacgtcctaacgaaacggaaacacgacgtactagtggaacacgaaaccctcgaagggtcagtactcaaccagtacgaacgactaagacaacactaacgaacgaacacacgacctacgagtaggaggtacggagggacgcgtagagtaagtagtacggacgaacggaccgtccgtagttagttagttggtcggaggtaaggttgggtaacggggtgttacgggngttagggtaaggtaacgttaacgttaaccggaaactttaaacgtttaaacgttaaccgtttaaag

SEQ ID NO: 363887 - DNA, 655 bp, Homo sapiens
  misc_feature: GZ8MTXP01C1QAX.13.86.H09.1.454.CMB.2.raw
  modified_base (187)..(187): a, c, t, g, unknown or other
  modified_base (244)..(244): a, c, t, g, unknown or other
  modified_base (300)..(300): a, c, t, g, unknown or other
tcagtcacgtactacacgaccggtgctcgatttagtgctatagacttgggtttggggcccctagatcacagctcctcaccatggactggacctggagcatcctttttcttggtggcagcagcaacaggtgcccactcccaggttcagctggtgcagtctgcagctgaggtgaagagccgtgggcctnagtgaagatctctgacaaggtctttcgtggttaaccacctttagcagtctatcttancagcgtggtgcgacgacggcccgaggacgaggactacgaggtggagtggagtggancacgaccccttaacgaaacggaacacgaagtacagtacggaacaacgtaaccgtaccgaacgggactagtactacccaacaagtacgaaccgaacaaacgaaccaacaactaaaccaaacgaaaccaaccgtaacgaaccctaacgtaagtagggaacgggtaggtaacgggacgtaccgtaggaacgtaataacgacgaacggtacgacggtacgtagttattagtgtcgagtaggtaggtaggagtggaacgtagttaggtaacttagtaaacgtaacttaaacgtttacttaacttaagttacgtaacggttcggaacgggttcgggtaacggggaacggtaaaaccggggg

SEQ ID NO: 363888 - DNA, 695 bp, Homo sapiens
  misc_feature: GZ8MTXP01DCYYP.13.86.H09.1.454.CMB.2.raw
  modified_base (286)..(286): a, c, t, g, unknown or other
  modified_base (590)..(590): a, c, t, g, unknown or other
tcagtcacgtactacacgaccggtgctcgatttagtgctatagacttgggtttggggcacccaaaaaaccacacccctccttgggagaatcccctagatcacagctcctcaccatggactggacctggagcattcctttttcttggtggcagcagcaacaggtcgcccactcccaggttcagctggtgcagtctgcagctggaggtagaagaagccgtgggcctgagtagaagtactcctctgcgaagtctttcgtagttacctacctttagcagtctatacttancagtcgtgggtcgcgaccgccggcccgtggacgaggacgtcggaggtaggagtgggagtcggtatcgaccgtaccctaaacgaacgaaacaccgacgtaactagacggaaccaaaccgaaccgtaaccggagggaccaagtactaccgaactagacgaacgacgaacgaacgaactaacgaaacccaacgaaacacgacaccgttaagagtagggtaggacggggaacggacggtacctaggaacgtagtacgtcgggaaaccgtaccggtacgggttacgttagtttacgtttaaggttcggngggtacggttagggttaaacgggtggggttaaacggttcgggttaagttaaggggttagaacgtttaaccgaacggttaaacttaaacgttttaactttaaaacg

SEQ ID NO: 363889 - DNA, 630 bp, Homo sapiens
  misc_feature: GZ8MTXP01EGCBK.13.86.H09.1.454.CMB.2.raw
  modified_base (285)..(285): a, c, t, g, unknown or other
  modified_base (425)..(425): a, c, t, g, unknown or other
  modified_base (453)..(453): a, c, t, g, unknown or other
  modified_base (488)..(488): a, c, t, g, unknown or other
  modified_base (576)..(576): a, c, t, g, unknown or other
  modified_base (584)..(584): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtcgcccactcccaggttcagctggtgcagtctgcagctgaggtagaagaacgccgtgggcctgagtgaagtctctcgtgacgtagtctttacgtacgttacctaccgtttagcagtctacttctancgagtcgtgggtacgaccgacgtaccggaccccgtagggacgacggtaccgtcggaggtagggaggtaggggtagtacggactacgaccgtacctaaacgaaacggaaacacgtacgacgtagacgacacgtaaccgcgnggacaagtactaccaacagtacgacganacgacaacacacaaacgtaacacgataccgtaagngtagggaaggtagaacggggacgacgttaagggataagtgacgaacgtacgacgtcggttagttatggtcgaggaggtagaggtcggnggttacgngaaggtaagaattaacaagtaaacttaacgttaaccttaagtaacg

SEQ ID NO: 363890 - DNA, 622 bp, Homo sapiens
  misc_feature: GZ8MTXP01DDVZY.13.86.H09.1.454.CMB.2.raw
  modified_base (221)..(221): a, c, t, g, unknown or other
  modified_base (456)..(456): a, c, t, g, unknown or other
  modified_base (506)..(506): a, c, t, g, unknown or other
  modified_base (555)..(555): a, c, t, g, unknown or other
  modified_base (574)..(574): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagaagccgtggggcctnagtgaagatctcctgcaaggtcttcgtgttactacctttagcagtctatcttatcagcgtgggtgacgacgacggtcccccgtagggtaacggaggtacgtcggaggtcgggtagtagggggatagggactaccgaacgtaccccttaaacgaaacggtaaacacgaacgaactagtacggacaacgaaacccgtcgaaggacagtaactccaactagacgaacacagacacganaacacgaaacacgacactacgagtagggagtaggagggacgacgtagganagtagacggaccgagaccggtcgtagttacgttgttgcggaggtaaggngggtagggtaggttcgggngttaagggttggaataacgtaacgaacttaaataaccttaagttaacg

SEQ ID NO: 363891 - DNA, 664 bp, Homo sapiens
  misc_feature: GZ8MTXP01BFI8N.13.86.H09.1.454.CMB.2.raw
  modified_base (216)..(216): a, c, t, g, unknown or other
  modified_base (356)..(356): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgagtgaagagcctgggcctnagtgaagatctcctgctaaggcttcgtggttacaccgtttagctagtctatctatcagtcgtgggtgcgacgacggcccctggacgaggactcggagtggagtggagtggatcgacgtacccttaacgaaacggtaaacnccgacgaactagtacggaacaacgaacccgtcgaaggggcaagacttcacctagacgacgacacgacaactacacaaccgaacacacgtacctaagagttagggaaaggtggggaaacggtacgtaccgtagggaacgtaagttaacgaggaaacccgtacgtaccggggtacgttagggttatttaagttccgggttggacggttaggtaaacgggtcggggttaagggttcgggacgtaaggggttaggtaacgtttaaagtaccccgggttaaaaacttaaaacgtttttaaccccgtttaaaag

SEQ ID NO: 363892 - DNA, 616 bp, Homo sapiens
  misc_feature: GZ8MTXP01EZYQF.13.86.H09.1.454.CMB.2.raw
  modified_base (270)..(270): a, c, t, g, unknown or other
  modified_base (280)..(280): a, c, t, g, unknown or other
  modified_base (567)..(567): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttcgtggttacacctttagcagctatcttancagctgggtncgacgacggcccctggacgaggactcggaggtggagtgggatggatcgacgacccttaacaaacggaaacacgacgactagtacggacacgaaaccctcgaagggcaggtacttaccaaccgtagtcgaaccgacaagaaccaacactaaccacgaaaccacgaacgcctaagacgtagggaacgtaggacgggtacggccgttaggaacgtagttagacgacggaaccgtacgggtaccgttgttaagttcgttggtgacggaggttacgggtaggaaggttcggngttaggtaacggtataacgtacgaacttaaagttaaccttaagttaacg

SEQ ID NO: 363893 - DNA, 635 bp, Homo sapiens
  misc_feature: GZ8MTXP01CBFHX.13.86.H09.1.454.CMB.2.raw
  modified_base (140)..(140): a, c, t, g, unknown or other
  modified_base (281)..(281): a, c, t, g, unknown or other
  modified_base (519)..(519): a, c, t, g, unknown or other
  modified_base (586)..(586): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcattccttttnttggtggcagcagcaacaggtgcccactcccaggttcagctggtgcagtctgcagctggaggtgaagagccgtgggctgagtgaagatctctgacgtaggtcttcgtggttaacctacctttagcctagtcttagtcttancagcgtggtcgcgtacgcggcccctaggacgaggactcggagtggagtggggattagggactccgaacgtaaccctaaagaaaccggaaacaacccgaagtacgtaagtacggaaacaaaccgaacccgcggaacgggacaaagtaccttaaccaacgtaagaccgaacgaacaaacgacttaaacactaaacgaaacgaacaactacgaacctaagaggaggaggtaggaacggtanacgtgaaagatacgagaaacgcgtaggtcgtagttgtaagttggaggtagaggtaggtaccggttgnggttacgtgggtataacgttaggaaccgttaattaaacttcgttaaacg

SEQ ID NO: 363894 - DNA, 719 bp, Homo sapiens
  misc_feature: GZ8MTXP01DY4BD.13.86.H09.1.454.CMB.2.raw
  modified_base (217)..(217): a, c, t, g, unknown or other
  modified_base (437)..(437): a, c, t, g, unknown or other
  modified_base (440)..(440): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatctcctgcaaggtcttcgtggttacacctttagcagtctatcgttatcgagtcgtagggtcgaccgacgacggccccctagggaccgacggactcggaggtggagtgggatcggactacgacgtacccttaacgaaacggaaacacgtacgactagaggtaacacggaaacccgtcgaagggcaagtaccttacgacctagtacggaaccanaanacacaactaccgaactaaaccacgacgacccgttaagagttagggaaggttacggaacgggggtacgtacccgttaaggaacgtaaggttaaccggacggttaaacccggaaccggttaaccgggtccccgggttttaaggtttaacgttacgggttttaaggtaacccgggacgggtaagggttaacggtacggggtaaggggttaccgggcggttaacgggtaagggtacgtttaacgacccggtaaattaaaacggttcctttaaaccggttaacg

SEQ ID NO: 363895 - DNA, 674 bp, Homo sapiens
  misc_feature: GZ8MTXP01C0IIP.13.86.H09.1.454.CMB.2.raw
  modified_base (227)..(227): a, c, t, g, unknown or other
  modified_base (278)..(278): a, c, t, g, unknown or other
  modified_base (331)..(331): a, c, t, g, unknown or other
  modified_base (341)..(341): a, c, t, g, unknown or other
tcagtcacgtactacacgaccggtgctcgatttagtgctatagacttgggtttggggcacccaaaaaaccacacccctccttgggagaatcccctagatcacagctcctcaccatggactggacctggagcatcctttttcttggtggcagcagcaacaggtgcccactcccaggttcagctggtgcagtctgcagctgaggtgaagagccgtgggctgagtgaagntctcctgctaaggctttcgtggttaccaccgtttagctagtctatcgttancgagcgtgggtcgccgacgacggcccgtaggacggaggactcggaggtggagngggatggacncgacgtacccttaaagaacggtaaacaccgagactagacggaacaaccgaacccgtccgaagggacacgtactccgaactagtacgaaccaacgaagaacaacactaaaccgaacgaacaacgacgaccttaacgaagtcgggtaaaggtacggaagggtaccgaccgtagaaacgtagtaacgtcggaaaccgtaacggtaccggttaccggttaagttacggtttaattgggaggttaccgggaaaggtagggttaggacgggttggttaccggtaaggagggtaaactaacggtaccggttaaaaactttaacttaacccggtttaaaag

SEQ ID NO: 363896 - DNA, 629 bp, Homo sapiens
  misc_feature: GZ8MTXP01CXIKA.13.86.H09.1.454.CMB.2.raw
  modified_base (227)..(227): a, c, t, g, unknown or other
  modified_base (272)..(272): a, c, t, g, unknown or other
  modified_base (285)..(285): a, c, t, g, unknown or other
  modified_base (359)..(359): a, c, t, g, unknown or other
  modified_base (559)..(559): a, c, t, g, unknown or other
  modified_base (576)..(576): a, c, t, g, unknown or other
  modified_base (579)..(579): a, c, t, g, unknown or other
tcagtcacgtactacacgaccggtgctcgatttagtgctatagacttgggtttggggacccaaaaaccacaccccctccttgggagaatcccctagatcacagctcctcaccatggactggacctggagcatccttttcttggtggcagcagcaacaggtgcccactcccaggttcagctggtgcagtctgcagctgaggtgaagagccgtggggcctgagtgaagntctcctgcaaggtcttcgtgttacacgtttagcagcttatcttancagtcgtgggtcncgacgcggccccgtaggacggaggacttcggagtggagtggatggatcgacgtacccttaaacgaaacggaaanacgaacgtacgtaagtcgggaaaccaacggtaaaacccctcgaacggggtacccaaagggtaaccttccgacctaagtacgaaacgacgaacgacaaacgaacgtaaaccaagaaaccacgaactacctaacgagtagggagttaggacgggacgactagaagtactagacgacgacgcggtacttagtagtttagtcgnggaggtgaggtgggtgnggngttaagggtaactaagtgtacgtaaacttaaactttaagaaccttttaag

SEQ ID NO: 363897 - DNA, 582 bp, Homo sapiens
  misc_feature: GZ8MTXP01BYWJR.13.86.H09.1.454.CMB.2.raw
  modified_base (271)..(271): a, c, t, g, unknown or other
  modified_base (281)..(281): a, c, t, g, unknown or other
  modified_base (425)..(425): a, c, t, g, unknown or other
  modified_base (478)..(478): a, c, t, g, unknown or other
  modified_base (486)..(486): a, c, t, g, unknown or other
  modified_base (530)..(530): a, c, t, g, unknown or other
  modified_base (540)..(540): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctgggcctcagtgaagatctcctgcaaggtcttcgtggttacacctttagctagctatcttancagctgggtncgacacggcccctggacgaggactcgagtggagtgggatgggatcgagtaccccttaagaaacggaaacaccgaagtactagtacgggaacaaacggaaaccctccggaagggacaaggtacttccgaacgagtacgaacgtanaacggactaacgactacaacgaactacacgacctacgagtcggaggtgaggancctagganactgtacggaacgacgtaccggtcttagtattaagtggttacgnggagtacggnggagttcgagtaagtggaacttagcgaaataacgttcgtaac

SEQ ID NO: 363898 - DNA, 694 bp, Homo sapiens
  misc_feature: GZ8MTXP01BD733.13.86.H09.1.454.CMB.2.raw
  modified_base (218)..(218): a, c, t, g, unknown or other
  modified_base (274)..(274): a, c, t, g, unknown or other
  modified_base (462)..(462): a, c, t, g, unknown or other
  modified_base (472)..(472): a, c, t, g, unknown or other
  modified_base (511)..(511): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagtatctccgtgacaggtcttctaggttactacctttagcagctatcttancgagtcgtgggtgccggacgaccggtccccgtgggaacggacggtaccgtcggtaggtagggtagtagggggagtagggactttccgaccgttacccgttaaacgaaaccggaaacaccgaacgtacgtacgtaacggaaccgtaaaccgaaacccgtcggaacgggaccaaggtacttacaccgtanacgaacgtanaacgactaagacaacgaaccgtaacacacgtaccaacgngtagggcgtaggggacgacgtaccgtaggaagtaagtacgacggaaccgtacggtaacccggtacgttagttaaacgttggttaggacggtaggttagggtagggtgttacgggttggacgttaaggggtaagtaacgttaaaccgtaacggttaaaactttaaacgtttaacccgtttaaag

SEQ ID NO: 363899 - DNA, 557 bp, Homo sapiens
  misc_feature: GZ8MTXP01EQMPJ.13.86.H09.1.454.CMB.2.raw
  modified_base (419)..(419): a, c, t, g, unknown or other
  modified_base (472)..(472): a, c, t, g, unknown or other
  modified_base (491)..(491): a, c, t, g, unknown or other
  modified_base (504)..(504): a, c, t, g, unknown or other
  modified_base (518)..(518): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagcgtgggtgcgacgacggcccctggacgaggactcggagtggagtgggatggatcgagtaccccttaacgaaacggaaacacgacgactagtcggaacaacgaaaaccctccgaaggcaagacttcaaccagcgaacgacaagacanaacaacgacgaaacacacgctacagtggaaggtggagggagcgtagagatagngacgacgcggtctgtattntggtgcggtaggnggtagggagttggngttaggtgataacgtagacttaaagttcttaagttaacg

SEQ ID NO: 363900 - DNA, 654 bp, Homo sapiens
  misc_feature: GZ8MTXP01BMY7W.13.86.H09.1.454.CMB.2.raw
  modified_base (578)..(578): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcgtgggcctgagtgaagatctcctgacaagtcttcgtaggttactacctttagcagtcttatcttatcgagtcgtgggtgcgacgcggccccgtggacgaggcgtcggaggtggagtgggatggactaccgacgtacccttaaacgaaacggaaacacgacgtaacgtagtacggaacaaccgaaaacccgtcggaacgggactaaacgtacttaccgaactacgtacgaaaccgacgaacgaaccaacaaacgtaccgaaaccgaaacaaccgacgaaccgtacgaaggtagggaagggtcggaacggggtactacggtaagaagtacgtacgacggtaccggaacgtaccggtcgttagttacgtttggnggttacgaggtaggaggttgggagttcggagttaggtaacgtataacgtacgtaaattacttaacttaacgttaag

SEQ ID NO: 363901 - DNA, 667 bp, Homo sapiens
  misc_feature: GZ8MTXP01AO79X.13.86.H09.1.454.CMB.2.raw
  modified_base (228)..(228): a, c, t, g, unknown or other
  modified_base (276)..(276): a, c, t, g, unknown or other
tcagtcacgtactacacgaccggtgctcgatttagtgctatagacttgggtttggggcacccaaaaaaccacacccctccttgggagaatcccctagatcacagctcctcaccatggactggacctggagcattccttttcttggtggcagcagcaacaggtgcccactcccaggttcagctggtgcagtctgcagctggaggtgaagagccgtgggctgagtgaagntctctgactaggtcttgtgttactacctttagctagtcttactcttancgtagtcgtgggtcgacgacgtaccggcccgtaggaccgaggtactcggaggtggtaggtgggtacgtgggtaactcgtacgtaacccgtaagaaaccggaaacacgaacgtactagtacgaactaaacgaccctcgaggacagtactacgacagtacacgacgacgtaacactaacaacgaacgaacacgtaacgtacctaagaggtacgggaaggtcggggaacggtaccgtacggagtaaacgacgtaacggacggtaaccggacggtaccgtcggttaattacgtttgtagggcggtaaaggttggtaggggttaggacgggttcgacggtaagggttagtaacgttaaccggacggttaaaacttaaacggtttaaccgtttaaag

SEQ ID NO: 363902 - DNA, 635 bp, Homo sapiens
  misc_feature: GZ8MTXP01BAYT5.13.86.H09.1.454.CMB.2.raw
  modified_base (280)..(280): a, c, t, g, unknown or other
  modified_base (569)..(569): a, c, t, g, unknown or other
  modified_base (591)..(591): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagacgccgtgggctgagtgaagatctcctagacaaggtcttcgtacggttacctacctttagctagtcttatcttancgagtcgtggtcgacgtacgacggccccgtaggacgacggaccgtaggaggtaggagtagggtagtcggactacgtaccgtacccgttaaacgaaacggtaaacacgaacgtacttaaggacggaaccaacggtaaaccccgtacgggaacgggactaagtaacttaccgaacgtagtacgaacgaacacgaacaacactaacgaacgaacacaacgaccagagtcggagtacgagggacgacgtagacgtagtacgacgaacgacgtacgtcgttagtacgttgtggngaggagttaggaggtagttggngttaggtgtacgtaagacgtaacttaagttaacgttaattaacg

SEQ ID NO: 363903 - DNA, 593 bp, Homo sapiens
  misc_feature: GZ8MTXP01EIJPT.13.86.H09.1.454.CMB.2.raw
  modified_base (277)..(277): a, c, t, g, unknown or other
  modified_base (395)..(395): a, c, t, g, unknown or other
  modified_base (435)..(435): a, c, t, g, unknown or other
  modified_base (533)..(533): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctggaggtgaagaagccgtggggcctgagtgaagatctcctgctaaggtcttcgtaggttaccacgtttagcagtctatcttancgagtcgtagggtgcgaacgacggtccccgaggacgaggtactcggaggtggagtggatggactcgacgtaccttaagaaacggaaacacgacgactaagcggaacacgtaaaacccncgaagggaccagtactacactagaggaacagacactaaanacgtacaacgaacacgactaccagagaggagtaggacggtacgtacgagacgagtagacgacgaacgtcggtagttagtacgtgtaagtcgaggtagnggtcggagttggacgttaggtaagtacttaagtacgaattaacttaacgttaacgtaacg

SEQ ID NO: 363904 - DNA, 248 bp, Homo sapiens
  misc_feature: GZ8MTXP02G59UN.13.86.H09.1.454.CMB.2.raw
  modified_base (248)..(248): a, c, t, g, unknown or other
tcagtcacgtactacacgaccggtgctcgatttagtgctatagacttgggtttggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccgccctcctctagtacgtgactgagcgggctggcaaggcgcatagn

SEQ ID NO: 363905 - DNA, 248 bp, Homo sapiens
  misc_feature: GZ8MTXP02JMAGD.13.86.H09.1.454.CMB.2.raw
  modified_base (248)..(248): a, c, t, g, unknown or other
tcagtcacgtactacacgaccggtgctcgatttagtgctatagacttgggtttggggtgtggtggtctccactcccgccttgacgaggccgactattactgcggaacatgggatagcagcctgagtttgggtgtcttcggcggagggaccaagctgaccgtccttcgtcagcccaaggctgccccctcggtcactctgttcccaccctcctctagtacgtgactgagcgggctggcaaggcgcatagn

SEQ ID NO: 363906 - DNA, 428 bp, Homo sapiens
  misc_feature: GZ8MTXP02FWCDI.13.86.H09.1.454.CMB.2.raw
  modified_base (423)..(428): a, c, t, g, unknown or other
tcagtcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttccccctggcaccctcctccaagagcacctctgggggcaccgagcggcctgggctcgcctggtcaaggactacttcctagtacgtgactgagcgggctggcaaggcgcatagnnnnnn

SEQ ID NO: 363907 - DNA, 588 bp, Homo sapiens
  misc_feature: GZ8MTXP02GPZOS.13.86.H09.1.454.CMB.2.raw
  modified_base (554)..(554): a, c, t, g, unknown or other
tcagtcacgtactacacgaccggtgctcgatttagtgctatagacttgggtttgggcacccaaaaccacaccctccttgggagaatccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactcggagtggagtggggatgggatcgacggtaccccttaacgaaaccggtaaacaccgaagaacctaagtaggggaacaacggaaaccctccgaagggggaccaaggtacttccgaaccagtacgaacgacaagacaacataaccaacgaaacaacacgacctaacagtagggaggtaggaggacgccgtagaagaagtataggacgtacgacgggtccgtaggttattagttggtagcggaagaggtggagtcgganaaggtgaactagtaccgaaactaagttactaaac

SEQ ID NO: 363908 - DNA, 521 bp, Homo sapiens
  misc_feature: GZ8MTXP02H1FQ8.13.86.H09.1.454.CMB.2.raw
  modified_base (329)..(329): a, c, t, g, unknown or other
  modified_base (338)..(338): a, c, t, g, unknown or other
  modified_base (381)..(381): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactcggagtggatgggatggatcagcctanaacggaacncagactatggacagaacctccgagggcagattcacatgacganagacacatacaacgaacacacgcctacagtggaggtgaggagcctaggagatagtacggaacgacgaaccgggccgtagtaattattggtgacgaggaagtgggagtggacaaggtggattagcgaactaatttactaac

SEQ ID NO: 363909 - DNA, 425 bp, Homo sapiens
  misc_feature: GZ8MTXP02GR17I.13.86.H09.1.454.CMB.2.raw
  modified_base (392)..(392): a, c, t, g, unknown or other
  modified_base (419)..(425): a, c, t, g, unknown or other
tcagtcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtctcccctggcaccctcctccaagagcacctctggggcaccagcggccctggggctgcctggtccaaggctactcctagtacgtnactgagcgggctggcaaggcgcatagnnnnnnn

SEQ ID NO: 363910 - DNA, 533 bp, Homo sapiens
  misc_feature: GZ8MTXP02JB14C.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacacggcccctggacgaggactcgagtggagtggggatggatcgagtccccttaagaaacggaaacacaagacctagtgggaacagaaccctccgaggggcaaggacttccaccatcgacgacagacacatacaacgaacacagaccctaacagtgggaggtgaggagcctgagatagagacgacgacggccgtagtattagtgtgcgagagtggagtggcaggtggatagtacgataaacgtactacttaa

SEQ ID NO: 363911 - DNA, 503 bp, Homo sapiens
  misc_feature: GZ8MTXP02H441R.13.86.H09.1.454.CMB.2.raw
  modified_base (389)..(389): a, c, t, g, unknown or other
  modified_base (433)..(433): a, c, t, g, unknown or other
tcagtcacgtactacacgaccggtgctcgatttagtgctatagacttgggtttggggacccaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctcagggcagattcaccatgacgacagacacanacacgaaacacagtaccacatggaagtgaggagctagagatagngacgacaacggccgtagtattatgtgcgtagagtggagtggcagtggatagtcgataaattactactaac

SEQ ID NO: 363912 - DNA, 533 bp, Homo sapiens
  misc_feature: GZ8MTXP02I31JK.13.86.H09.1.454.CMB.2.raw
  modified_base (452)..(452): a, c, t, g, unknown or other
  modified_base (500)..(500): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatggggatgggatcagcccttagaaacggaaacaccagactatggacagaacctccgagggcagattcaccatgacgacagacacataacacgaaacacacgacctacagtagggaggtagagggtagccgtagagactagngacgacacggcgttgtattagtggtacgcgaaggagtggacgttgganaagggtgatacgtacgaactaaatttacttaaa

SEQ ID NO: 363913 - DNA, 250 bp, Homo sapiens; identical to SEQ ID NO: 363846
  misc_feature: GZ8MTXP02GKFFT.13.86.H09.1.454.CMB.2.raw
  modified_base (249)..(250): a, c, t, g, unknown or other

SEQ ID NO: 363914 - DNA, 531 bp, Homo sapiens
  misc_feature: GZ8MTXP02FOL4B.13.86.H09.1.454.CMB.2.raw
  modified_base (483)..(483): a, c, t, g, unknown or other
  modified_base (499)..(499): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacacggcccctggacgaggactcggagtggagtggggatgggatcgagccccttaacgaaacggaaacacagactagtggacagaacctcgagggcagacttcaccatgacacagacacatacaacgaacacagaccctacagtgggaggtagaggacgccgtagagatagagacgacgacggccgtagtattagttgtcgngagaggtggagtcggnagtgatagtacgaactaaagttactacttaag

SEQ ID NO: 363915 - DNA, 546 bp, Homo sapiens
  misc_feature: GZ8MTXP02HZM1I.13.86.H09.1.454.CMB.2.raw
  modified_base (393)..(393): a, c, t, g, unknown or other
  modified_base (463)..(463): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctatcagctgggtgcgacgacggcccctggacgaggactcgagtggatgggatggatcgagccctaacgaacggaaacacgacgactagtcggacagaaccctcgacggggcaagtacttccaacctanacgacgacacgaacacaactacaaacgaacacacgacctaacagtaggaggtgaggacgctagagatagngacgaacgcggcgtagtattagtgtagcgagaggtggagtcggagaggtaagatacgtaccgaaataactttactaacttaag

SEQ ID NO: 363916 - DNA, 513 bp, Homo sapiens
  misc_feature: GZ8MTXP02HI56R.13.86.H09.1.454.CMB.2.raw
  modified_base (350)..(350): a, c, t, g, unknown or other
  modified_base (379)..(379): a, c, t, g, unknown or other
  modified_base (391)..(391): a, c, t, g, unknown or other
  modified_base (393)..(393): a, c, t, g, unknown or other
  modified_base (424)..(424): a, c, t, g, unknown or other
  modified_base (436)..(436): a, c, t, g, unknown or other
  modified_base (480)..(480): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagtcccttaagaacggaaacacagactanggacagaacctcgaggggcagatcaccangacgacagacananacaacgaacacagcctacatggagtgaggancgtagagatagngacgacgacggcgtagtattagtgtgcggagaggtggagtcggnaggtggatagtacgaactaaacttactacttaa

SEQ ID NO: 363917 - DNA, 504 bp, Homo sapiens
  misc_feature: GZ8MTXP02FQNU9.13.86.H09.1.454.CMB.2.raw
  modified_base (332)..(332): a, c, t, g, unknown or other
  modified_base (384)..(384): a, c, t, g, unknown or other
  modified_base (390)..(390): a, c, t, g, unknown or other
  modified_base (438)..(438): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcgagcccttaanaacggaaacacgacgactatggacaggacctcgagggcagatcacatgacanagacanatacacgaacacagacctacatggaggtcgaggagccgtagagatagngacgacacggcgtagtattgttgagcgagaggtgagtgcagtggatatcgactaaatacacttaag

SEQ ID NO: 363918 - DNA, 553 bp, Homo sapiens
  misc_feature: GZ8MTXP02GUETH.13.86.H09.1.454.CMB.2.raw
  modified_base (268)..(268): a, c, t, g, unknown or other
  modified_base (278)..(278): a, c, t, g, unknown or other
  modified_base (423)..(423): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctancagctgggtncgacaggcccctggacgaggactcgagtggatgggatggatcgacgtcccttaacgaacggaaacacacgactatcggaacagaaccctccgaggggcagtacttacaccatgacgacagacacatacaacgaacacagccctanagtggagtgaaggacgaccgtagagatagtacgaccgacgacgggaccgttagtagttaagttgtacggtagaggaggttagggagtggacgaggtggaatagtacgaactaaatttactaactttaacg

SEQ ID NO: 363919 - DNA, 542 bp, Homo sapiens
  misc_feature: GZ8MTXP02GSFGX.13.86.H09.1.454.CMB.2.raw
  modified_base (218)..(218): a, c, t, g, unknown or other
  modified_base (327)..(327): a, c, t, g, unknown or other
  modified_base (375)..(375): a, c, t, g, unknown or other
  modified_base (391)..(391): a, c, t, g, unknown or other
  modified_base (432)..(432): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctnagtgaagatctcctgcaaggcttctggttacacctttagcagctatctatcagctgggtgcgacaggcccctggacgaggactcgagtggatggatggatcagccctanaacggaaacacagactatggacagaaacctcagggcagattcaccatnacgacagaacacaaanacaacaaacaacacacacagagaggagaggagacgagaganagagacgaacgacggacgtagtagttaagttagtaggagagaggtaggtaggtaggacgaggtaaggtaagtaacgtaacgaaacgtaaaacttaaacttaaacttaaac

SEQ ID NO: 363920 - DNA, 564 bp, Homo sapiens
  misc_feature: GZ8MTXP02JT1PQ.13.86.H09.1.454.CMB.2.raw
  modified_base (420)..(420): a, c, t, g, unknown or other
  modified_base (436)..(436): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggaggatcctcttcttggtggcaacagccacaggagcccactcccaggtgcagctggtgcagtctggggctgaggtgaagagccgtggggcctcagtgaaggtctcctgcaagacctctggatacaccgtcaccgacgacccatatatactgggtgcgacaggcccctggacaaggccttgagtggatgggacatatcagccctgtcagtggtgccacaaagtttgcacagtactttcgaggcgagggtcaccatcgaccgacgacacgtccatcaacacagcctacatagaacngagagacctaagatcngaccgacgaccggtaccgtttattacgttgtagactaaagtaaaagtaattagaaactaaaacggtatacggtacttttacggattagtaagggtacgggacctaaaggggacacgttagactacccg

SEQ ID NO: 363921 - DNA, 614 bp, Homo sapiens
  misc_feature: GZ8MTXP02GG40P.13.86.H09.1.454.CMB.2.raw
  modified_base (413)..(413): a, c, t, g, unknown or other
  modified_base (466)..(466): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagcgtggtgcgacacggcccctggacgaggactcggagtggagtgggatggatcgacgtacccttaacgaaacggaaacaccgaagactagtacggaacaacgaacctcggaacgggcagtactaccaacatacgaacganacgacaacataacaacgaacacaacgacctaacagtagggaagtaggaacggngacccgtaggaagtaagtaagtacggaacggtaaccgacgggtaccgtagttaagtttacgttggtaggacggtaaggagggttacgggacggttggagaagggtagtaacgtacgtaaccgaaagttaaaactttaccgttaaaacg

SEQ ID NO: 363922 - DNA, 553 bp, Homo sapiens
  misc_feature: GZ8MTXP02JXAKC.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggaactggagcatccttttcttggtggcagcagcaacaggtgcccactcccaggttcagctggtgcagtctgcagctgaggtgaagaagcctggggcctcagtgaagatctcctgcaaggcttctggttacactttagcagctatcttatcagctggtgcgacaggcccctggacgaggactcggagtggagtgggatgggactcgacgtacccttaacgaaaccggaaacaccgagactagtggacagacctccgagggcagatcacatgacgacagacacataacacgaacacacgcctaacgagtaggggaggtacggagggagccgtaggacgtagtagacggaacgacgaccggcgttagtatttagtgtggcgaggacgtgggacgtggacgtaaggtggtatacgtacgaactaaattacttaaacg

SEQ ID NO: 363923 - DNA, 576 bp, Homo sapiens
  misc_feature: GZ8MTXP02GR6M5.13.86.H09.1.454.CMB.2.raw
  modified_base (334)..(334): a, c, t, g, unknown or other
  modified_base (537)..(537): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggtcttctggttacacctttagcagctatcttatcagctggtgcgacaggcccctggacgaggactcgagtggatgggatggatcgacgtccctaanaaacggaaacaccgagactagtcggaacacgaacctccgagggcaaggtactcaacagtacgacgacaagacacgaacacaacgaacactaacgaccaacgagtaggggaagtaggaacggagcccgtagggaagtaattaagcggaaacgaacgacgggtaccgtagtagtttagtggtaggcgaaggagtacgggagtggntaaggtggaacttagtacgaaactaaacgtttacttaaa

SEQ ID NO: 363924 - DNA, 578 bp, Homo sapiens
  misc_feature: GZ8MTXP02IS3E4.13.86.H09.1.454.CMB.2.raw
  modified_base (330)..(330): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctgggcctcagtgaagatctcctgcaaggcttctggttacacctttagcagctatcttatcagctggtgcgacaggcccctaggacgaggctcgagtggatgggatggatcgagcccttaanaacggaaacacagactatacggaacacgaaccctcaggggcaagtacttaccaccagtcgaaacacacgaacacaactaacaacgaaacaccaacgacctaacgagtacgggaggtacgaggacgcctagagaatacgtagacgacgaacggtccgttagtagttattggtgaggaggtaaggttacggaggtaggcgtaaggtaaggtaattagtacggaaactaaaactttacctaactttaaacg

SEQ ID NO: 363925 - DNA, 507 bp, Homo sapiens
  misc_feature: GZ8MTXP02GJNUT.13.86.H09.1.454.CMB.2.raw
  modified_base (279)..(279): a, c, t, g, unknown or other
  modified_base (332)..(332): a, c, t, g, unknown or other
  modified_base (447)..(447): a, c, t, g, unknown or other
  modified_base (454)..(454): a, c, t, g, unknown or other
  modified_base (469)..(469): a, c, t, g, unknown or other
  modified_base (483)..(483): a, c, t, g, unknown or other
  modified_base (492)..(492): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtncgacaggcccctggacgaggactcgagtggatgggatgggatcagcccttaanaaacggaaacaccagactatcggacagaacctcgagggcagattcaacatcgaacgacagacaacataacaacgaacacacgcctaacataggaggtgaaggagcctagagatangacgacnggctagtattatgtncgagagtgacgtgnaagtgatancgaactaattactaa

SEQ ID NO: 363926 - DNA, 629 bp, Homo sapiens
  misc_feature: GZ8MTXP02JHRLB.13.86.H09.1.454.CMB.2.raw
  modified_base (337)..(337): a, c, t, g, unknown or other
  modified_base (447)..(447): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacacggcccctggacgaggactcgagtggatggggatgggatcgacgccccttanaaacggaaacaccgagactagtacggacacgaaccctcgaggggacagacttccacctatacgaaccgacgaacgacaacactaacaaccgaaccacgaacgaccctaanacgtagggaggtaggaagggacgaccgtaggaagtatacgtaggaaccgacggtacgggtaccgttaggttaatttaacggtttcggtacggtacggtaaggtacgggttacggggtaacggttggacgtaaggtcggaaacgtttagaaccggtaaactaaaacgtttaccgtttaaaacg

SEQ ID NO: 363927 - DNA, 508 bp, Homo sapiens
  misc_feature: GZ8MTXP02HO8K8.13.86.H09.1.454.CMB.2.raw
  modified_base (278)..(278): a, c, t, g, unknown or other
  modified_base (330)..(330): a, c, t, g, unknown or other
  modified_base (393)..(393): a, c, t, g, unknown or other
  modified_base (411)..(411): a, c, t, g, unknown or other
  modified_base (434)..(434): a, c, t, g, unknown or other
  modified_base (436)..(436): a, c, t, g, unknown or other
  modified_base (468)..(468): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctatcagctgggtncgacaggcccctggacgaggactcgagtggatgggatggatcagcccttaanaacggaaacacacgactatggacagaacctcgaggggcagattcaaccatgacacagacacanacaacgaacacagcctanagtggaggtgaggagctggagananagacgacgacggcgtagtattattgtgcgagnggtggagtgcgagtgatagtacgaataacttactacttaa

SEQ ID NO: 363928 - DNA, 555 bp, Homo sapiens
  misc_feature: GZ8MTXP02HJKN4.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagcgtgggtgcgacgacggcccctggacgaggactcgagtggatgggatggatcgagcccttaacaaacggaaacacacgactagtacggaacacgaaccctcgaggggaccaagaacttccgaacctagtacgacgaacagaaccaacaactaacaacgaaacacacgacctacagaggaggtagaggacgtcagagatagagacgacgacggtcgtagtattagtgtacgagtagagtggagtcggataggtgaatacgacgtaataattaacctacgttaag

SEQ ID NO: 363929 - DNA, 624 bp, Homo sapiens
  misc_feature: GZ8MTXP02HL1CW.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctatcagctgggtgcgacacggcccctggacgaggactcgagtggagtgggatggatcgagtaccccttaacaaaccggaaacacgaacgtactaagtggaaccaacggtaaaccccgtcgacgggggaccaaagtactttaccaccctaagacgaaccgaacagaactacaacgtaacaacgaaacacaacgacctaacgagtagggaggtaggacggtacgcctaggagataagtacgaacgacgacggtaccgtagtaagttagttgtcggtaggaggtaaggttcggagtacgggtagagggtaaggtaagtacgttaacggaaacttaaaacgttaacctttaaacgtttaaacg

SEQ ID NO: 363930 - DNA, 587 bp, Homo sapiens
  misc_feature: GZ8MTXP02HQ4XY.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttcgtggttacacctttagcagctatcttatcagctggtgcgacgaggcgccgtggacgaggactcgaggtggagtgggatggatcgacgtaccctaagaaacggaaccacgagactagtaggaccagacctcgagggcagattaccacatagacacagacacaactaacaacgaactacgacgaccctaacagttacgggaaggtaggaagggacgtccgtaaggaagtaagttaacgacgaaacggaccgaccgggtccgtaagtttaacgttagtttggcgtaggaggtaggtaggacgttagggcgtaggtcgtaagtacgtacgaaacttaaaatttaaccg

SEQ ID NO: 363931 - DNA, 502 bp, Homo sapiens
  misc_feature: GZ8MTXP02HPS7E.13.86.H09.1.454.CMB.2.raw
  modified_base (211)..(211): a, c, t, g, unknown or other
  modified_base (297)..(297): a, c, t, g, unknown or other
  modified_base (304)..(304): a, c, t, g, unknown or other
  modified_base (312)..(312): a, c, t, g, unknown or other
  modified_base (336)..(336): a, c, t, g, unknown or other
  modified_base (402)..(402): a, c, t, g, unknown or other
  modified_base (425)..(425): a, c, t, g, unknown or other
  modified_base (431)..(431): a, c, t, g, unknown or other
  modified_base (442)..(442): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttntggttacacctttagcagctatcttatcagctgggtgcgacaggcccctggacgaggactcgagtggatggatggatcagccctanaacgaancagactanggacagacctcaggcagatcacangacgacagaacacaatacatacgaaacacagtacctacagtggaggtgaggagccgtagagattangacgacacgggctagtatattgngcgagngtggagtcggntaggtaggatatcgaaactaattacaattataacgtgaggtaccgtagtacggggaaacg

SEQ ID NO: 363932 - DNA, 561 bp, Homo sapiens
  misc_feature: GZ8MTXP02FVS4X.13.86.H09.1.454.CMB.2.raw
  modified_base (414)..(414): a, c, t, g, unknown or other
tcagtcacgtactacacgaccggtgctcgatttagtgctatagacttgggtttggggacccaaaaaccacacccctccttgggagaatcccctagatcacagctcctcaccatggactggacccggagcatccttttcttggtggcagcagcaacaggtgcccactcccaggttcagctggtgcagtctgcagctgaggtgaagaagccgtggggcctcagtgaagatctcctgcaaggtcttctggttacacctttagcagctatcttatcagcgtgggtgcgacgacggcccctggacgaggctcggagtggagtggatggatcgacgacccttaacgaaacggaacacgagacctagtcggaacacgtaacctcgagggcacgattaccacagtacgacgacagacaacanacaacgacacacgactacagtaggaggagaggacgacgtagacagtagacgacgacgacggtcgtagtagttagtgtagagagtaggtaggagtcgagtaggtagtaacgtaacgtacgaaacgtaattacgtaactaatttaacgg

SEQ ID NO: 363933 - DNA, 542 bp, Homo sapiens
  misc_feature: GZ8MTXP02IQXFW.13.86.H09.1.454.CMB.2.raw
  modified_base (346)..(346): a, c, t, g, unknown or other
  modified_base (365)..(365): a, c, t, g, unknown or other
  modified_base (388)..(388): a, c, t, g, unknown or other
  modified_base (441)..(441): a, c, t, g, unknown or other
  modified_base (447)..(447): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttcgtggttacacctttagcagctatcttatcagtcgtgggtgcgacacggcccctggacgaggactcgagtggatgggatggatcagcccttaagaacggaaacacagactagtcgaacagaacctcgaggcagntacacatgacgacagacanactacaacgaacacagccctaanagtggagtagaggagctagagataagacgacgacgacgcgtagtattagttgngagagngtaggacgtgacgaggtagactaataccggaaactaaaattacctaaattaattaacgagtacggaacgtacggtacggggaactaaaacggggg

SEQ ID NO: 363934 - DNA, 619 bp, Homo sapiens
  misc_feature: GZ8MTXP02JBONV.13.86.H09.1.454.CMB.2.raw
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttcgtggttacacctttagcagctatcttatcagtcgtgggtgcgacgacggccccgtggacgaggactcggagtggagtggatggactcgacgacccttaacgaaacggaaacacgagactagtcgacacgaacctcgaggacagactacacagcgacgacagacacactaacaacgaacacacgaccctaagagtaggaggtagaggacgccgtagagtatagtacggaaccgaacgtaccgggtaccgttaggttacgtttagttcggtagacgggtaggtagggtagggaggtcgggacgtagggtaggtaactaaacgtacgtaaacttaaaacgtttacttaacttaacgttaacgtacggttacgggtaaccgtacgggtaacggggtaacggaaaacgggg

SEQ ID NO: 363935 - DNA, 551 bp, Homo sapiens
  misc_feature: GZ8MTXP02G3U72.13.86.H09.1.454.CMB.2.raw
  modified_base (351)..(351): a, c, t, g, unknown or other
  modified_base (367)..(367): a, c, t, g, unknown or other
  modified_base (385)..(385): a, c, t, g, unknown or other
  modified_base (398)..(398): a, c, t, g, unknown or other
tcagtcacgtactacacgaccggtgctcgatttagtgctatagacttgggtttggggccccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtgcgacacggccctggacgaggactcgagtgatggatggatcagcccttaacgaacggaaacacagactagtcggaacagaacctcgagggcagatcgactancgacgacagactacanacacgaacacagtaccanagtgagtgagganccgtagagtatagcgacgacgacggtacgtagttaatagttgagagtaggaggttaggacgttggacgtaggtggaaccttagaccggaaataaacttacctaataacgtttaaacgacggttacggacgttacggacggggaacgtaacggg

SEQ ID NO: 363936 - DNA, 593 bp, Homo sapiens
  misc_feature: GZ8MTXP02J3ITT.13.86.H09.1.454.CMB.2.raw
  modified_base (394)..(394): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacgacggcccctggacgaggactcggagtggatgggatggatcgacgcccttaacgaaacggaaacaccgagactagtacggacacgaacctccgagggacagatcacctancgacacagactacactacacgaacacagacctacagtacggaggtaggaggagtccgtaggaagtatacgtacggaaccggtacgaccgggtaccgtagttaaatttcgttaggtacggacggtaagacgggttggacggttagggaccgtaaggtacggtaattacgtaaccggtaaacttaaaacgttacttaaacg

SEQ ID NO: 363937 - DNA, 612 bp, Homo sapiens
  misc_feature: GZ8MTXP02HJFYK.13.86.H09.1.454.CMB.2.raw
  modified_base (268)..(268): a, c, t, g, unknown or other
  modified_base (496)..(496): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctancagcgtgggtgcgacgaggcccctggacgaggactcgagtggagtggggatggatcgacgtacccttaacgaaacggaaacacgacgaactagtacggaacacgaaccctcgacggggcaagtacttaccaaccagtacgaacgacaagaccaacgaactaaccacgaaacaccgaacgaccctaacgagtagggtaacggtaggacgggacgtaccgtaggaagtanagtacgacgaacgacggaccgtagttaagttagtttggacggtcgaagggtaggtgggaacggtcggtagagggtaagtatacgtacggtaaactaaacgtttactaactttaaag

SEQ ID NO: 363938 - DNA, 529 bp, Homo sapiens
  misc_feature: GZ8MTXP02HW55I.13.86.H09.1.454.CMB.2.raw
  modified_base (243)..(243): a, c, t, g, unknown or other
  modified_base (307)..(307): a, c, t, g, unknown or other
  modified_base (388)..(388): a, c, t, g, unknown or other
  modified_base (427)..(427): a, c, t, g, unknown or other
  modified_base (449)..(449): a, c, t, g, unknown or other
  modified_base (477)..(477): a, c, t, g, unknown or other
  modified_base (487)..(487): a, c, t, g, unknown or other
  modified_base (493)..(493): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgacaaggcttntggttacacttagcagctatctatcagctgggtgcgacgacggccctggacgaggactcggagnggagtggatggatcgagccctaagaaacggaaacacagactagcggaacacgaacctcgacgggcaagacttacaacctanacgacgacaacgacaacacaacacgaacacagacctaanagtagagagagagacgagaganagagacgacgacggtctagtattagtgngagagtaggnggacgngagagtgtactagtacgaataaacgttactaactag

SEQ ID NO: 363939 - DNA, 589 bp, Homo sapiens
  misc_feature: GZ8MTXP02HKPMH.13.86.H09.1.454.CMB.2.raw
  modified_base (243)..(243): a, c, t, g, unknown or other
  modified_base (278)..(278): a, c, t, g, unknown or other
  modified_base (383)..(383): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttntggttacactttagcagctatcttatcagctggtncgacaggcccctggacgaggactcggagtggatgggatgggatcagcccttacaaacggaaacacagactataggacagaacctcgagggcagatcacatgacanagacacatacacgaacacacgcctacagagggacggtagaagggtacgccgtaggaagacttaagacggaaccgaacgaccggtaccgtagttaacgtttaacgttggttcggacggtaagggtaggttacggggtagttacggggacgaagggttagggaaagttacgtaaccggtaaacttaaaacgtttaacgtttaaaaccg

SEQ ID NO: 363940 - DNA, 631 bp, Homo sapiens
  misc_feature: GZ8MTXP02I7VEB.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttctggttacactttagcagctatcttatcagcgtgggtcgcgacgacggccccgtggacgaggactcgaggtggagtgggatgggatcgacgtaccccgttaacgaaaccggaaacaacccgaagtacgtaagtacggaacaacggtaaaccctccggaaacggggacaaggtacttaccgaaccgtaagtacgaaaccgaacaacgaacctaacgaactaaaccgaaacgaaccaacgtaacaccgtaacgagttagggagggtagaacggacgaccgtaggaatagtagacggaccgaacggacggtcgtagttatttacgtgtagacggagtaggtaggacggtgagtaaggtagtaagtacgtacgaaattaaaacttacgtaaa

SEQ ID NO: 363941 - DNA, 642 bp, Homo sapiens
  misc_feature: GZ8MTXP02IP0RB.13.86.H09.1.454.CMB.2.raw
  modified_base (218)..(218): a, c, t, g, unknown or other
  modified_base (267)..(267): a, c, t, g, unknown or other
  modified_base (277)..(277): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctnagtgaagatctcctgcaaggcttctggttacactttagcagctatctancagctgggtncgacgacggcccctaggacggaggacgtacggaggtggagtgggaatggatccaacggtaccccttaaacgaaaaccggaaaacaccgaagtaaccgttagtaggaaccgaacgtaaaccccgttcccgagggggactaaacggaacgtttacccaaccgtaagtacgaaaccgaacaacggaaaccaacaactaaacccaaccgaaacaaccgacgtaaccctaagaggtagggaggtacggaaggacgtccgtagaacgtaatagtacggaacgacgacggtcgttagtattagttgaggtacgaggtaggtgggacgtggctaggtaagtatacgtacgaaataaacgtttactaagttaac

SEQ ID NO: 363942 - DNA, 559 bp, Homo sapiens
  misc_feature: GZ8MTXP02IXNDA.13.86.H09.1.454.CMB.2.raw
  modified_base (330)..(330): a, c, t, g, unknown or other
  modified_base (360)..(360): a, c, t, g, unknown or other
  modified_base (390)..(390): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttanaacggaaacacacgactatgacagacctcngggcagattacaccatgacacagacacaanacaacgacacagacctaacagtcggaggtagaagggagaccgtagagtagtaagtacgaacggacgaaaccgggtccgttagtatttagtagtaggtacggaggtaaggtggggaagtcgggacgaggtggacgtaagtacgaaactaaacgtttaactaactttaacg

SEQ ID NO: 363943 - DNA, 612 bp, Homo sapiens
  misc_feature: GZ8MTXP02H72OJ.13.86.H09.1.454.CMB.2.raw
  modified_base (273)..(273): a, c, t, g, unknown or other
  modified_base (284)..(284): a, c, t, g, unknown or other
  modified_base (578)..(578): a, c, t, g, unknown or other
tcagtcacgtactacacgaccggtgctcgatttagtgctatagacttgggtttggggacccaaaaaccacacccctccttgggagaatccccctagatcacagctcctcaccatggactggacctggagcatccttttcttggtggcagcagcaacaggtgcccactcccaggttcagctggtgcagtctgcagctgaggtgaagaagccgtggggcctcgagtgaagatctcctgacaaggcttcgtggttacacctttagcagctatctancagcgtgggtncgacgacggcccctggacgacggactcggagtggagtcgggatggaactcgaacgtacccttaaacgaaaacggaaacacgacgaactagtacgaactaacgaacccgtccgagggccaaaggtacttaccaaacccgagtacgaaaccaacaacggaccaacgtaacaaaccaacgaaaacctacaacgtaccaacgaggtacgggaaagggtggaacggaacgtccagggataatagacgaaccgacgacgggtactagttgttactggacgtgagaaggttcgacggtcgngtagtggataagcgaaaactaatacgtactaaag

SEQ ID NO: 363944 - DNA, 496 bp, Homo sapiens
  misc_feature: GZ8MTXP02FNZWS.13.86.H09.1.454.CMB.2.raw
  modified_base (339)..(339): a, c, t, g, unknown or other
  modified_base (347)..(347): a, c, t, g, unknown or other
  modified_base (381)..(381): a, c, t, g, unknown or other
  modified_base (472)..(472): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagccctacaacggaaacncagactangacagaacctcagggcagattcaccatgacgacngacacatacagacacagactacatggaggtgaggagctgagatatgacgacacggcctagtattattgtgacgtaggagtggagtggcagnggatagtcgactaatacacttaag

SEQ ID NO: 363945 - DNA, 542 bp, Homo sapiens
  misc_feature: GZ8MTXP02FO5ZK.13.86.H09.1.454.CMB.2.raw
  modified_base (464)..(464): a, c, t, g, unknown or other
  modified_base (487)..(487): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcgagtgaagatctcctgcaaggcttctggttacactttagcagctatcttatcagctggtgcgacaggcccctggacgaggactcgagtggatgggatggatcgagccctaacaacggaaacacagactagtaggaacacgaaacctcgaggggccaaggtattaccacctatcggaacgaacagaaccacaataacaacgaaacacacgacctaacagtggaaggtgaaggacgctagagatagngacacgacggcgtagtatattgngacgagagtggagtggcgaggtggtatacgtacgaataaactacgtaacttaacg

SEQ ID NO: 363946 - DNA, 608 bp, Homo sapiens
  misc_feature: GZ8MTXP02IUL2I.13.86.H09.1.454.CMB.2.raw
  modified_base (268)..(268): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtgggctgagtgaagatctctgcaaggtcttctggttacactttagcagctatcttancagcgtggtgcgacacggcccctgggacgaggactcggaggtggagtggggattgggatcgacgtaccctaaacgaaacggaaacaccgagacgtagtaggacaacgaacctccgaagggcaagtacttaccaacgatcggaaacgacaaacgacaaccaataaccgaacgaaacacaacgaccctaagagtagggaaggtaggaacgggacgaccgtaggaagaaagtacgtacgggaacgaaccggacggtaccgtagtaagtttaacgtggagacggagtaggtggtaacgtggacgaaggttagaacgttaagtacgaaactaaaagttctaaacg

SEQ ID NO: 363947 - DNA, 627 bp, Homo sapiens
  misc_feature: GZ8MTXP02GTV0J.13.86.H09.1.454.CMB.2.raw
  modified_base (283)..(283): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtgggcctacagtgaagatctcctgcaaggtcttctggttacacctttagcagtctatcttatcagcgtgggtncgacacggcccctaggacgaggactcggagtggagtgggatggactcgacgccccttaaacgaaacggaaacacgacgtactagtacggaacctaacgaaaccctccggacggggcaaaggtacctttaccgaacccgtaagtacgaaaccgaacaacgaacaacaactaacaaccgaaacctaccacgtaccacgagtagggaggtggaacggcgacgtagaggtatagacggacgaaccggtacggaccgttagttagttagttcgtacggaggtaggtaggtaggaggtcggaagtggtaaggattaacggttacaaaaccttaaagtttacctaattaag

SEQ ID NO: 363948 - DNA, 633 bp, Homo sapiens
  misc_feature: GZ8MTXP02IPWTN.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctggaggtgaagaagccgtggggcctcagtgaagatctcctgcaaggcttctggttacacctttagcagctatcttatcagctgggtgcgacgacggcccctggacgaggactcggagtggagtgggatggatcgagtcccttaacgaaccggaaacacacgactagtacggacacgaacccgtcgacggggacaacggtacttaccgaaccctagtacggaaccgaaacgacgaaccaacaactaaccaaacgaaaccacgaacgacctaacgagtagggaacggtaggaacggacgaccgtaggaagaacgttagacggaacgaccgacgggtacccgttagtaacgtttagttcggaggtacggtaggtagggtacggtacggtcggagtaggtaacgtaagtacgtacgtaaacttaaaactttactaactttaag

SEQ ID NO: 363949 - DNA, 578 bp, Homo sapiens
  misc_feature: GZ8MTXP02GW3MX.13.86.H09.1.454.CMB.2.raw
  modified_base (449)..(449): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacactttagcagctatcttatcagtcgtgggtcgacgacgacggcccctaggacgaggactcggagtggagtgggatgggatcgacgtacccttaagaaacggaaacaccagactagtacggaacaacgaacctccgaagggacaagacttacaaccatacgaacgacagaacacaataacacgaacacaacgaccctaanagtaggaacggtgaacggtacgcctaggaagtaactaagcgaaacgacgacgggtactagtaattacgtagtgacgtagaggtaggacgtggagtaagtgaacttagcgtaaactaacgttactaaacg

SEQ ID NO: 363950 - DNA, 639 bp, Homo sapiens
  misc_feature: GZ8MTXP02H4OSS.13.86.H09.1.454.CMB.2.raw
  modified_base (218)..(218): a, c, t, g, unknown or other
  modified_base (269)..(269): a, c, t, g, unknown or other
  modified_base (279)..(279): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctnagtgaagatctcctgcaaggcttctggttacacctttagcagctatcttancagctgggtncgacacggcccctggacgaggactcggagtggatgggatggatcgagaccctaagaaacggaaacacgagactagtaggaactacgaacctccgaggggccaaggtacttacaaccatacgaaccgacaagaacacaactaaccgaacgaaacacacgaccctaaacgagtacgggaaggttaggaacgggtacgaccgtaggaaggtactaagtacggaaccggaacgaacgggtccgttagtaacgtttagttacggtaggacggaggtagggttacgggtaacgggttcggacgtaggtaaggtaacgttaaacgtaccgtaaaaagtaaaacgttttaactaaaaccgtttaaacg

SEQ ID NO: 363951 - DNA, 622 bp, Homo sapiens
  misc_feature: GZ8MTXP02FTBBK.13.86.H09.1.454.CMB.2.raw
  modified_base (427)..(427): a, c, t, g, unknown or other
  modified_base (457)..(457): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttctggttacacctttagcagctatcttatcagtctgggtgcgacacggcccccgtggaccgaaggctcggaggtggagtgggagtggatcacgtacccctaacgaaacggaaacacgacgaactagtaggaacacgaaccctcgaggggcagtaactccaaccagtagaacgaacagaacctaanaacacgaaacgaaacacaacgaccctaaanagtgggaaggtaggaaggaacgccgtagaacggaattacgcgaagaaccgacgggtccgtagttaatttagttcggtggacggaggtaggtgggacggttaggcgtaaggtaaggtaaagttacgtaaccgtaaaagtaaaacgtttaaccctaagtttaaaacg

SEQ ID NO: 363952 - DNA, 680 bp, Homo sapiens
  misc_feature: GZ8MTXP02JACBV.13.86.H09.1.454.CMB.2.raw
  modified_base (484)..(484): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttcgtggttacacctttagcagctatcttatcagtcgtgggtcgcgacgacggcccctggacgaggacgtcgagtggagtgggatggatcgaacgtacccttaacgaaccggaaaacacgaacgtaacgtagtacggaaccaacgaacccgtcgacggggcaacggtaacttaccgaacctaagtacgaaccgaaacgaacgaactaacaaactaaccgaaacgaaacacaacgaccctaaanagtaggaagggtagagggacgaccgtagagtaatacgtacggaacggaacgtacggtaccgttagttaacgtttaaggtttcggtaggaccgggtaagggttaagggtacggggtaacggttgggaccgtaaagggttgaaaggttaacgtaaccggtaaaacgtaaaacgttttaaccgtaaacgttttaaaacg

SEQ ID NO: 363953 - DNA, 562 bp, Homo sapiens
  misc_feature: GZ8MTXP02I2I3A.13.86.H09.1.454.CMB.2.raw
  modified_base (269)..(269): a, c, t, g, unknown or other
  modified_base (278)..(278): a, c, t, g, unknown or other
  modified_base (506)..(506): a, c, t, g, unknown or other
  modified_base (531)..(531): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaagtgcccactcccaggttcagctggtgcagtctgcagctgaggtgaagaagccgtggggcctcagtgaagatctcctgcaaggcttctggttacacctttagcagctatctancagctggtncgacaggcccctggacgagactcgagtggatgggatggatcacgtcccctaaagaaccggaaacacacgactataggacacgaacctaccgaggggcaggaacttcgaacctagtacgacgaaacctaaagaccaaacaactaacaaaccgaaacacgtaagccctaagagtagggacggtaggagacgcgtagagatagcgacgactacggctagtatcgtagtcgngtaggaggtacgaggtccgagtagngtaagtatacgaacctaaattacgtactaag

SEQ ID NO: 363954 - DNA, 581 bp, Homo sapiens
  misc_feature: GZ8MTXP02GGK10.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctggtgcgacaggcccctggacgaggactgagtggatgggatggatgacgcccttaagaacggaaacacagatagtacggaactaaggaaccctccgaaggggcaaggaacttaccaaccataggaaccgacaagtaccaacaataacgaaacgaacaccgaagtccctaaagagtagggaggtagaacgggacgcgtaaggagtaaagtagtacggaaccgaaacggtaccggaccgttagtaaattagtcgtaggacgagtaggtggaagtgagaagtggaactagtacaacgtaacttactaacg

SEQ ID NO: 363955 - DNA, 664 bp, Homo sapiens
  misc_feature: GZ8MTXP02FLK9Y.13.86.H09.1.454.CMB.2.raw
  modified_base (281)..(281): a, c, t, g, unknown or other
  modified_base (286)..(286): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggtcttcgtggttacacctttagcagctatctatcagctgggtncgacncggcccctggacgaggactcgaggtggagtgggatggatcgacgtccccttaagaacggaaacacaacgactagaggacacgaaccctcgaggggcaggtattaccaccatcgacacagacaacaactaacaacgaaacacgaacgaccctaacgagtagggaagggtaggaaagggacgccgtaggaaacggtaataacgacggaaccggaaccggtaaccgggtccggttagtttaaacgtttaagttcggtacggtacggtaagggtaagggtcggggtaaacgggttcggggaccgttaaaggggtaacggggtaatttaaacggtaaaccggtaaaacgttaaaaacgtttaaaccgttaacgtttaaaaccg

SEQ ID NO: 363956 - DNA, 589 bp, Homo sapiens
  misc_feature: GZ8MTXP02HTS8R.13.86.H09.1.454.CMB.2.raw
  modified_base (552)..(552): a, c, t, g, unknown or other
tcagtcacgtactacacgaccggtgctcgatttagtgctatagacttgggtttgggcacccaaaaaccaacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagcgtgggtgcgacgaggcccctggacgacggctcgaggtggagtgggatgggatcgagcccttaacgaaacggtaaacaccgagtactagtagggaactaacggaaccctcgaaggggcaacgagttaccaaccatacgaacgacaacgacaacactacgaaaccgaactacacgaccctagacgtagggcgggtaggaacgggtacgctagggaacgtatacgtagaccgacgacggtcgttagtactttatcggtgacgaggacggttggaggtggngtaaggtgaagttacgagaaccttaagttacctaaag

SEQ ID NO: 363957 - DNA, 632 bp, Homo sapiens
  misc_feature: GZ8MTXP02G7G27.13.86.H09.1.454.CMB.2.raw
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggctttcgtggttactacctttagcagctatcttatcagtctgggtgcgacgacggcccctggacgagacgtcgaggtggagtgggacgtggactcacggtccccttaaacgaacggaaactacgacgaactagtaggaacacgaacctacgaggggacaacggtacttacgaacctaagtcgaaacgacaacgaacacaacgtaaacgaaccgaaacaaccgacgacccgtaacgacgtagggacggtaggaacggacgtaccgtagaagtacgttaacgacggaaccgtacccgacggtaccgttaggttaattaaggttcgtacggacgaaggtaggttcggagtacgggactaggtaagatacgaacgtagaaaactttacgtaacttaag

SEQ ID NO: 363958 - DNA, 575 bp, Homo sapiens
  misc_feature: GZ8MTXP02GZXL3.13.86.H09.1.454.CMB.2.raw
  modified_base (277)..(277): a, c, t, g, unknown or other
  modified_base (288)..(288): a, c, t, g, unknown or other
  modified_base (520)..(520): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttccagctggtgcagtctgcagctgaggtgaagaagccgtggggcctcgagtgaaggatctcctgcaaggtcttcgtggttaccacctttagcagctatcttancagcgtaggtncgacacggcccctggacgagacctcggaggtggagtgggatggatcgacgtcccgttaagaaacggtaacacgtaagacttagcggaacacgaaccctcgagggacaagtacttaccaccgatcggaacacgtaacgacaacataacccgacgaaccactacgaccctagagtagggagtacgaggacgtcgagacgatagcgaaccgacgtacggcgttgtaatttcgtgngtacggagtaggtgacgtggagaaggtgatacgtacgaaacttaactttactaac

SEQ ID NO: 363959 - DNA, 567 bp, Homo sapiens
  misc_feature: GZ8MTXP02G32J5.13.86.H09.1.454.CMB.2.raw
  modified_base (397)..(397): a, c, t, g, unknown or other
  modified_base (407)..(407): a, c, t, g, unknown or other
  modified_base (417)..(417): a, c, t, g, unknown or other
  modified_base (512)..(512): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctctgcaaggtcttctggttactacctttagcagctatcttatcagtcgtgggtgcgacgcggcccctggacgaggactcggagtggagtgggatgggactcgacgtcccttaaacgaaacggaacaccgagactagtacggacacgaacctcgaggacagactcaacntacgaacganagaacacaanaccgaacaaccacacgacctacagtagggaggtaggagggtacgacgtaggaacgagtagacgaacgacgacggtccgtagtagtttagtgacgngaggtagtcggagtcgagtggtagtacgtacgacgtaactaaacgttacgttaac

SEQ ID NO: 363960 - DNA, 554 bp, Homo sapiens
  misc_feature: GZ8MTXP02HJJX5.13.86.H09.1.454.CMB.2.raw
  modified_base (218)..(218): a, c, t, g, unknown or other
  modified_base (276)..(276): a, c, t, g, unknown or other
  modified_base (385)..(385): a, c, t, g, unknown or other
  modified_base (405)..(405): a, c, t, g, unknown or other
  modified_base (413)..(413): a, c, t, g, unknown or other
  modified_base (415)..(415): a, c, t, g, unknown or other
  modified_base (442)..(442): a, c, t, g, unknown or other
  modified_base (451)..(451): a, c, t, g, unknown or other
  modified_base (458)..(458): a, c, t, g, unknown or other
  modified_base (466)..(466): a, c, t, g, unknown or other
  modified_base (475)..(475): a, c, t, g, unknown or other
  modified_base (495)..(495): a, c, t, g, unknown or other
  modified_base (509)..(509): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatctctgacaaggtcttgtaggttacctacctttagcagacttatcttaancagtcgtgggtgacgacgcggccccgtaggacgaggtaccgtggagtggagtgggatgggactcacgtacctaaagaaacggaaacacgtagactagacgacaacgacncgaggacagtactacgacancgaacgananacactagaccaagacatacgacctagngtagggagnggagtcnaggaatangacgaacgngtaccgtgttaagtattagnggagaggaggtagngagcggagtaaggtacaagtacgtaactaaactaacgttaactag

SEQ ID NO: 363961 - DNA, 572 bp, Homo sapiens
  misc_feature: GZ8MTXP02HX9P7.13.86.H09.1.454.CMB.2.raw
  modified_base (218)..(218): a, c, t, g, unknown or other
  modified_base (350)..(350): a, c, t, g, unknown or other
  modified_base (359)..(359): a, c, t, g, unknown or other
  modified_base (403)..(403): a, c, t, g, unknown or other
  modified_base (410)..(410): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagagccgtgggcctnagtgaagatctcctgcaaggtcttcgtggttacacctttagcagctatctatcagcgtgggtgcgacgtacggccccgtaggacgaggacctggagtggagtgggtatggatcacgtacctaacgaacgaanacagactanggacacgaaccctcgaggggcaagtactaccaacagtcgacganagaccanacaacaacgaacacacgtacctacgagaggaaggtagaggtacggccgtaggagatagcggtaacgaccggtacgtacgttagtatttagtcgttaggacggtagtacgggtaggtggtacgagaggtaagacttagtaccgaataacttacgtaacttaag

SEQ ID NO: 363962 - DNA, 687 bp, Homo sapiens
  misc_feature: GZ8MTXP02H39GZ.13.86.H09.1.454.CMB.2.raw
  modified_base (280)..(280): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtgggcctcagtgaagatctcctgcgaaggtcttcgtggttacctacttagcagctatctatcagctgggncgacgacggcccctgggacgacggcgtcggaggtggagtgggagttggactcgacgtaccccttaaagaaaccgggaaaacaccgtaagtaaccgtagtacgggaaaccaacggtaaaccccgtccggaggggaccaacggtactttacccgaacccgtaatacggaacccggaacacgaacctaacaacgtaacccaacgaaaccaccgtacgacctacaggtaggaaggtggaacggacgtcgagaagagttaacgacggaaccgacggaaccgggtccgttaaggttaactttaggttacgttgggacggaacgggttaggtagggtaggtcgggtagtacgggtaagggtaaccttaagtaccggtaaaagtaaaaccgtttttaaccaaacgttttaaacgg

SEQ ID NO: 363963 - DNA, 627 bp, Homo sapiens
  misc_feature: GZ8MTXP02JS15N.13.86.H09.1.454.CMB.2.raw
  modified_base (229)..(229): a, c, t, g, unknown or other
  modified_base (276)..(276): a, c, t, g, unknown or other
  modified_base (314)..(314): a, c, t, g, unknown or other
  modified_base (367)..(367): a, c, t, g, unknown or other
  modified_base (466)..(466): a, c, t, g, unknown or other
  modified_base (502)..(502): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcattcctttttcttggtggcagcagcaacaggtgcccactcccaggttcagctggtgcagtctgcagctgaggtgaagacgccgtgggcctgagtgaagntctctgacgagtcttctggttacacgtttagcagtctatctatcagngtggtgcgacgacggcccgtaggacgaggctcggaggnggagtggatggactcgacgtaccctaacgaaacggaaacacgaagtacgtaanacggacaacgaaccctcggagggacaacgtacttaccgactagtacggaacacgaacgaaccaactaacaaccgaacgaaaccaccacgtacctaacgngtaagggtaggaggaaggacgtacgtaggagttaanacggacgacggaaccgaccgggtcgttagtttaaacgtttggtaggtacggacggtagtagggtacggagggttcgacgtaaggtaggtaaacgttacgaagttaaactaaacgttatttaaacg

SEQ ID NO: 363964 - DNA, 651 bp, Homo sapiens
  misc_feature: GZ8MTXP02JKFGN.13.86.H09.1.454.CMB.2.raw
  modified_base (268)..(268): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaagtgcccactcccaggttcagctggtgcagtctgcagctgaggtgaagaagccgtgggcctgagtgaagatctctgcaaggtcttctggttacactttagcagctatcttancagcgtgggtcgcgacgacggcccctggacggaggacctcggagtggatgggatgggatcgacgtaccccttaaagaaaccggaaacacgaacgtaaccgtagtacggaacctaacggaaaccctaccggaggggcctaaaggtacttacccaaccgtaaagtaccggaaacgaaacaacgaaacaacgaactaaccgaaaccgaaacaccgaacacctaacgacgtacgggaggtacggaaggacgacgtagaagtagtaacgaggaaccgacgacggtaccgttagttacgttagttaggtcgagggaggtagggtaggacggtacggagtaaggtaaggtaaagtacgtaccaaagttaaactttacgtaactttaaacg

SEQ ID NO: 363965 - DNA, 571 bp, Homo sapiens
  misc_feature: GZ8MTXP02FD7OE.13.86.H09.1.454.CMB.2.raw
  modified_base (280)..(280): a, c, t, g, unknown or other
  modified_base (331)..(331): a, c, t, g, unknown or other
tcagtcacgtactacacgaccggtgctcgatttagtgctatagacttgggtttggggcacccaaaaaaccacacccctccttgggagaatcccctagatcacagctcctcaccatggactggacctggagcatccttttcttggtggcagcagcaacaggtgccactcccaggttcagctggtgcagtctgcagctgaggtgaagaagcctggggcctcagtgaagatctcctgcaaggcttctggttacacctttagcagctatcttatcagctgggtncgacacggccctggacgaggactcgagtggatgggatggatcacgtcctanaaacggaaacacagactatggacacgaacctccgagggcagattcacagtacgacgacagacctaacataaccgacgaaactacacgcctacagtgggaggtgaggagcctaggagacttaagtggaacgacgacgggtaccgttagtaagtttaacgttggtacggacggaggtagggtacgggaacgttggacgtaaggtaggtaactacgtacgaaaactaaaactttacttaaacg

SEQ ID NO: 363966 - DNA, 641 bp, Homo sapiens
  misc_feature: GZ8MTXP02FKE5K.13.86.H09.1.454.CMB.2.raw
  modified_base (278)..(278): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacaccttagcagctatcttatcagctgggtncgacacggcccctggacgaggctcgagtggatgggatggatcgacgcccgttaaacaaacggaaaccacaacgtactagtcggaacaacggaaccctacgagggggaccaaggtacttccgaacctaagtaggaaaccgaacgaagaacccaacaataaaccaacgaaaccaacaacgtaccctaacgaagttagggaagggtaggaagggacggaccgagaaggaattagaggaacggaacgtccgggtaccgtagtttaagttagtttacggtaggtgaacggggtaggtgggtacggtaggcttaggggtaaggtagttaacgttacggaaactttaaatttaacgtaacgtttaaaacg

SEQ ID NO: 363967 - DNA, 598 bp, Homo sapiens
  misc_feature: GZ8MTXP02HU3XW.13.86.H09.1.454.CMB.2.raw
  modified_base (218)..(218): a, c, t, g, unknown or other
  modified_base (279)..(279): a, c, t, g, unknown or other
  modified_base (542)..(542): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctnagtgaagatctcctgcaaggcttctggttacacctttagcagctatctatcagcgtgggtncgacgacggcccctggacgaggactcgagtggagtggatggatcgacgtaccctaaacgaaacggaaacacgtaacgactagtcgaacagaaccctcgacggggaccaagtacttaccaacctagtgaaacgaccaagaacccaacaactaaccaacgaaacactagaccctaagaggtagggaggtacgaggacgtacgtagacgaagtagtagaaaccggacgtaacggtcgttagtatttagtcggttagcgtaaagggnggttaggacggtcgagtaggtaagataacgtacgaaattaaactttactaattacg

SEQ ID NO: 363968 - DNA, 522 bp, Homo sapiens
  misc_feature: GZ8MTXP02I7CMP.13.86.H09.1.454.CMB.2.raw
  modified_base (335)..(335): a, c, t, g, unknown or other
  modified_base (355)..(355): a, c, t, g, unknown or other
  modified_base (388)..(388): a, c, t, g, unknown or other
  modified_base (441)..(441): a, c, t, g, unknown or other
  modified_base (447)..(447): a, c, t, g, unknown or other
  modified_base (480)..(480): a, c, t, g, unknown or other
  modified_base (505)..(505): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatctatcagctggtgcgacaggcccctggacgaggactcgagtggagtgggattggatcgaacgcccttaanaaacggaaacaccagactanaggacaagaacctccgagggcagatcgaacatnacgacagaacacataacacaacgacacgcaacgataggagtagacggagaccnggaaanaagtagagacgacgacgacgtagtagttagtgngacgagagagagagagaagagaganagaacaactaactaacg

SEQ ID NO: 363969 - DNA, 605 bp, Homo sapiens
  misc_feature: GZ8MTXP02JVE22.13.86.H09.1.454.CMB.2.raw
  modified_base (219)..(219): a, c, t, g, unknown or other
  modified_base (416)..(416): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctnagtgaagatctcctgacgaaggtcttcgtcggttactactttagctagtctatcttatcgagcgtggtgccgtacgcggccccgtaggacgaggactggagtggagttgggatggatcgacgtacctaagaacgaacacgagactagtacgacacgacctcggacggtcacgtactcgacctagtacgactacgaanacaacgataaccgaacgaaccacgacgtacctagacggtcgggagtaggaacggacgtcgaggaacgtagtacggacgaacggtccgacggtacgttagttaacgtttagtaggtcgagggtagagggttaggacggttggagtaaggtaagtacgttaacgtagtaaacttaaacgttaccttaaacg

SEQ ID NO: 363970 - DNA, 593 bp, Homo sapiens
  misc_feature: GZ8MTXP02FMHNX.13.86.H09.1.454.CMB.2.raw
  modified_base (219)..(219): a, c, t, g, unknown or other
  modified_base (320)..(320): a, c, t, g, unknown or other
  modified_base (448)..(448): a, c, t, g, unknown or other
  modified_base (457)..(457): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctggaggtgaagagcctggggcctnagtgaagatctcctgacaaggtcttctggttaccaccttttagcagctatcttatcagcgtgggtcgcgacgacgccccgtggacgaggactcggagtggngtgggagtggactcgacgtaccctaacgaaacggtaacaccgagtactagtacgaacacgaccgtccggaggcagtactccaacagtcgaacgacagacacgaactaacaacgaacacacgacctaanacgtagggnggtaggaggacgtcgtagacgtagtagtacgacgacgaccgggtacgttagtaactttacggttgaggtacggaggtacggtggaggtcggagtaaggtagaagtacgtaacgtaacgtaaacttacgtttaaacg

SEQ ID NO: 363971 - DNA, 630 bp, Homo sapiens
  misc_feature: GZ8MTXP02F0WAR.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagcgtgggtgcgacgacggcccctggacgaggactcgagtggagtgggatggatcgacgtcccttaacgaaacggaaacaccgagactagtacggacaacgaacctccggagggactagtactaccaacgagtacgaacgacaagacaacataacgaacgaaccacacgacctaacagtacgggaggtagaacgggacgaccgtaggaacgtaagtacgtacggaaccgtaaccgaccggggttaccgtaggttaacgtttaacgttgggttaacggcggtaaaggttacgggtacggggaaggttcggaaggtaaggtaggaacgttagtaccggaaattaaacgtttaacttaaacg

SEQ ID NO: 363972 - DNA, 628 bp, Homo sapiens
  misc_feature: GZ8MTXP02IDJCP.13.86.H09.1.454.CMB.2.raw
  modified_base (217)..(217): a, c, t, g, unknown or other
  modified_base (275)..(275): a, c, t, g, unknown or other
  modified_base (416)..(416): a, c, t, g, unknown or other
tcagtcacgtactacacgaccggtgctcgatttagtgctatagacttgggtttggggcacccaaaaaccacacccctccttgggagaataccctagatcacagctcctcaccatggactggacctggagcatccttttcttggtggcagcagcaacaggtgcccactcccaggttcagctggtgcagtctgcagctgaggtgaagagccgtgggctnagtgagatctctgcaggtcttcgtggttactacttagcagtctatctatcagcgtggngcgacgacggccccgtggacgacggactcggaggtggagtggggatgggactcgacgtacccgttaacgaaacggaacaccgaagtactagacggaactaacgaacctcggagggcaagtactacacgagtacgaaccganacgacacaacgaacaacgaacactacgacctacgagtagggacggtaggacggacgacgtagggaagtagtaacgacggaccggtaacgtaccggggtacgtttaggttaactttaacggttgggtacggtacggtagggtaagggttcggagggttcggaggtaaggtagtaagtacgtaaccgtaacgttaaaacgtttactttaaaacg

SEQ ID NO: 363973 - DNA, 596 bp, Homo sapiens
  misc_feature: GZ8MTXP02I1H94.13.86.H09.1.454.CMB.2.raw
  modified_base (471)..(471): a, c, t, g, unknown or other
  modified_base (487)..(487): a, c, t, g, unknown or other
  modified_base (498)..(498): a, c, t, g, unknown or other
tcagtcacgtactacacgaccggtgctcgatttagtgctatagacttgggtttggggcacccaaaaaccacaccccctccttgggagaatcccctagatcacagctcctcaccatggactggacctggagcatccttttcttggtggcagcagcaacaggtgcccactcccaggttcagctggtgcagtctgcagctgaggtgaagagccgtggggcctgagtgaagatctcctgcaggtcttctggttacacctttagcagctatcttatcagcgtgggtcgaccggacgacggcccccgtgggaccggaggacgtcggagtgggagtgggatggactcgaccgtacccttaacgaaacggtaacaccgagtactagtacgggaacaaccggaaccctcggagggacagtactaccgacctagtacgaacgacagaactacgaatacaaacgaacctacgaacgctaacngtaggaacgtggacgngaccgaggtanaagttagaggacgaacgcggtacgtagttattagtggagcggtaggcggtaggaggtcgagtaaggtgtaatacgacgtaaactaactttacctaaag

SEQ ID NO: 363974 - DNA, 465 bp, Homo sapiens
  misc_feature: GZ8MTXP02F8OW9.13.86.H09.1.454.CMB.2.raw
  modified_base (216)..(216): a, c, t, g, unknown or other
  modified_base (248)..(248): a, c, t, g, unknown or other
  modified_base (449)..(465): a, c, t, g, unknown or other
tcagtcacgtactacacgaccggtgctcgatttagtgctatagacttgggtttgggatggatcagcccttacaacggaaacacagactatggacagaacctccagggcagattcaccatgacgacagacacatacacgaacacagcctacatgggaggtgaggagcctgagatatgacgacacggccgtagtattattgtgcgagagtggagtggnagtggatatcgaactaaattactactattacngtggacgtcgtggggacaaagggacgacggtcaccgtttcgcacgcctccaccgacggcccatcggtcccttccccgtcggccacccctcctaccagacgccacctcgtcggggccacgacgccgcccgtgggctcgcctggtacgaggtactactccgtacgtacgtcgtacgtgacggcggcgtggacgagcgcagagnnnnnnnnnnnnnnnnn

SEQ ID NO: 363975 - DNA, 607 bp, Homo sapiens
  misc_feature: GZ8MTXP02HW48E.13.86.H09.1.454.CMB.2.raw
  modified_base (442)..(442): a, c, t, g, unknown or other
  modified_base (458)..(458): a, c, t, g, unknown or other
  modified_base (506)..(506): a, c, t, g, unknown or other
tcagtcacgtactacacgaccggtgctcgatttagtgctatagacttgggtttggggcccctagatcacagctcctcaccatggactggacctggagcatccttttcttggtggcagcagcaacaggtgcccactcccaggttcagctggtgcagtctgcagctgaggtgaagagccgtggggcctcgagtcgaagactcgtcctggccaaggtctttctggttacaccgttttagcagtctattcttatcagtcgtggtgcgacgacggccccgtggaacgacggactcggagtggagtcgggatggacttcgacgtaccccttaacgaaaccgtaaaaccaacgaacgtactaagtacggaacaaacgtaaccccgtcgacggggaccagtactaccaactagcgacgacaagacacactaacgaacaacacagacctanagtgggagtagagganctaagcgaatacgagtacgaacgtacggcgtagtacgttagtgtaggngtaggagtaggagtcggacgtaggtagtaacgtacgacgtaaactaaacttaacgtaacttaagttacgaggtacgtacggtacggacgggtacgaacggg

SEQ ID NO: 363976 - DNA, 547 bp, Homo sapiens
  misc_feature: GZ8MTXP02GI0W5.13.86.H09.1.454.CMB.2.raw
  modified_base (352)..(352): a, c, t, g, unknown or other
  modified_base (394)..(394): a, c, t, g, unknown or other
  modified_base (403)..(403): a, c, t, g, unknown or other
  modified_base (431)..(431): a, c, t, g, unknown or other
  modified_base (447)..(447): a, c, t, g, unknown or other
  modified_base (458)..(458): a, c, t, g, unknown or other
  modified_base (485)..(485): a, c, t, g, unknown or other
  modified_base (493)..(493): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgagtgaagagcctgggcctcagtgaagatctcctgcaaggtcttctggttacaccgtttagcagtctatcttatcagtcgtggtcacgtacgacggcccctggacaggactcggagtggagtggatgggactcgacgtacctaagaaacggtaacncccgaagtactaagtggaacacgacctcgaggcagactcacntacgacganacgacacatacacgaacagtcgacctangtacggagtgaggacncgtagacgtanagacgacgacgacgtcgtatatagtgngacgtagngtaggtacgtagagaaggtacgtaacgtacgaacgtaacttaaacgttactaag

SEQ ID NO: 363977 - DNA, 597 bp, Homo sapiens
  misc_feature: GZ8MTXP02F3G66.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagcgtggtgcgacacggcccctggacgaggactcggagtggagtgggatgggactcgacgtacccgttaacaaacgggtaaacacgaagacctagtacggaacacgaacctccgagggacagtacttcaaccgagtagaacgacgaagtaccaacaactaaccgaacgaaccaacgacgacctaaacagtagggaggtacggaaggacgaccgtagagattacgacgacgtaacgacggtacgtagttattagtggtagacgtaggacggtacgggagtaggcgaaggtagaagttacgacgtaaactaaacttacgtttaaacg

SEQ ID NO: 363978 - DNA, 697 bp, Homo sapiens
  misc_feature: GZ8MTXP02JQEIA.13.86.H09.1.454.CMB.2.raw
  modified_base (217)..(217): a, c, t, g, unknown or other
  modified_base (273)..(273): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtgggcctnagtgaagatcctcgtgacaggtcttcgtaggttactacgttagcagtctatcttancgtagtcgtgggtcgcgacgccggtcccgtaggacggacgacgtcggaggtaggagtgggtagtaggactccgaaccgtacccgttaaaacgaaacgtaaaccgataaccgtaacgtacgaacggaaccaaacggtaacccgtcgggacggggacctaacgtaaccgttacccgaaacgtaacggtacgaaacccgaaacgaacgaaccaaactaaacgaacccaaaccgtaaacaccgaacgtaccccaaagtaggtacggaaggaggacgacggacgtagaaggttacaggacgaaccgtacgtaccggtattaagttagttaggttcggacggtaggaagggtagtagggtaacggtcggtaagtaggtaacggtaacgttaacgtacgtaaaaccgttaatttaacctacgtttaaacgg

SEQ ID NO: 363979 - DNA, 636 bp, Homo sapiens
  misc_feature: GZ8MTXP02F9EBH.13.86.H09.1.454.CMB.2.raw
  modified_base (190)..(190): a, c, t, g, unknown or other
  modified_base (256)..(256): a, c, t, g, unknown or other
  modified_base (397)..(397): a, c, t, g, unknown or other
  modified_base (413)..(413): a, c, t, g, unknown or other
tcagtcacgtactacacgaccggtgctcgatttagtgctatagacttgggtttggggccccctagatcacagctcctcaccatggactggacctggagcattccttttcttggtggcagcagcaacaggtgcccactcccaggttcagctggtgcagtctgcagctgaggtgaagaagccgtggggcctnagtgaagatctcctgcaaggtcttcgtggttacacctttagcagtctatcttatcgagtcgtgggngccgacacggcccctaggaccggaggaccgtgaggtaggagtgggatggatcgacgtaccctaacgaaacggaaacacgaagactaggtacggaaacaacgaaccgtacgacggtacaagtactaccaccatacgaccganacgtaacatactaaanacgaacgaaacacaacgacctaagaggtagggaaggcgggaaggaccgtcggaagagtaaagtacgaagggaccgtaaccggccgggttacggttattaacgtttagtggtacggaggaggtaggtgggtaacgtggtacgtaggtacggtaatacgtaacgtaaaacttaaacgtttactaagtttactagtagtacggtacgtacgggtagggtaaaccgg

SEQ ID NO: 363980 - DNA, 610 bp, Homo sapiens
  misc_feature: GZ8MTXP02GSVY9.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctctgacaaggcttctggttacactttagcagctatcttatcagcgtggtgacgacgacggcccccgtggaccgaggcgtcgagtggacgtgggatgggatcgacgtcccgttaacgaaaccggtaaacaaccgagacctagtacggaacaacggaaccctcggaagggcaaggtacttacaaccgtagtacgaacgtacaagacaacaacgtaacaacgaacaacgacgacctagaacgttagggaagtaggacggagccgtaggaagtactagtcgacggtaacgaccggtcgtagttaagtttagttacgaggtacggaggtacggtggtacgtggagtaaggtaggtatacgtacgtaactaaacgtttaccttaaag

SEQ ID NO: 363981 - DNA, 730 bp, Homo sapiens
  misc_feature: GZ8MTXP02IOYKY.13.86.H09.1.454.CMB.2.raw
tcagtcacgtactacacgaccggtgctcgatttagtgctatagacttgggtttggggcacccaaaaaaccacacccctccttgggagaatcccctagatcacagctcctcaccatggactggacctggagcatccttttcttggtggcagcagcaacaggtgcccactcccaggttcagctggtgcagtctgcagctggaggtgaagagccgtggggcctcgagtgaagtactctcctgacaaggtcttcgttacggttactacctttagcagtcttatcgttactcaggtcgtggggtcgccggaacgaccgggtcccccgtaggggaaccggtacggtaaccgtcggtaaggttcggaaggtggggtaacgtacgggtacttaccgaaccggttaaccccgttaaacggaaaaaccggtaaaccaaccgaaacggtacttaacggaacggtaaccaaaccggtaaccctcggggaggtaccgaaacgtacgttacccaagtaacgacgaaaccgaagaccgaaacaacaacctaaacccgaaacaacccgtaacgacccgtaaccgtaagaccggtaggggtacgggtaaggaacgggtacgtaccgaggtaacgtacgtagtaacggacgtaacggcgttacgtagttacttgtgaggcgtaaaggtggtaggacggtgaagtaaggtcgtaagtacggtaacctaacgttaaacgttaacttaacg

SEQ ID NO: 363982 - DNA, 637 bp, Homo sapiens
  misc_feature: GZ8MTXP02JAR9L.13.86.H09.1.454.CMB.2.raw
  modified_base (295)..(295): a, c, t, g, unknown or other
  modified_base (580)..(580): a, c, t, g, unknown or other
  modified_base (609)..(609): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagaagccgtgggcctgaggtagaagtatctcgtgcgaaggtcttacgtggttacctaccgtttagctagtcttattctatcagcgtggtcncgacgacggccccgtaggacgtaggctcggaggtggagtgggagtggactcgaccgtacccgttaaacgaaacggtaacaccgaagtactagtacgacaacgaacctcggacggactagacttaccaactagtacgaacgacacgaacaacgtaactaccgaaacacaaacgacgtaaccaacgagttacggggaacggaggacggtacgaccggtagaacgtagtagaccgacggaacgtacggtacgttagtacgtttacgtgttaggagggtaaaggtcggngggtacgtggaggtaaggtagttaaacgngtaaactaacgttaactaactttaaacg

SEQ ID NO: 363983 - DNA, 610 bp, Homo sapiens
  misc_feature: GZ8MTXP02ISJ9T.13.86.H09.1.454.CMB.2.raw
  modified_base (215)..(215): a, c, t, g, unknown or other
  modified_base (223)..(223): a, c, t, g, unknown or other
  modified_base (378)..(378): a, c, t, g, unknown or other
  modified_base (413)..(413): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaagtgcccactcccaggttcagctggtgcagtctgcagctgaggtgaagagcgtgggctnagtgaagntctctgcaaggtcttcgtggttacacttagcagtctatcttatcagtcgtgggtgccgacgacggccccgtaggacgaggcgtcgaggtggagtgggatggactcgacgtacccctaacgaacggaaacacgagacgtagtacgaacacgaaccncgagggcagtactaccactagacgacgacagacanaactaacgaacgaaacaccgactaccaagagtagggacggtaggaaggacgccgtaggacgtaacgtacgtacgaacggtacggtaccgggtcgttaagttattaggtttggacggaggtagggtaggaggggtacgtacggagtaaggtgtaaactaaggttaacgaaacttaaaacgtttcgtaaaacctttaag

SEQ ID NO: 363984 - DNA, 724 bp, Homo sapiens
  misc_feature: GZ8MTXP02JJ7QI.13.86.H09.1.454.CMB.2.raw
  modified_base (218)..(218): a, c, t, g, unknown or other
  modified_base (226)..(226): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagcctggggcctnagtgaagntctcctgcaaggcttctggttacacttagcagctatctatcagcgtggtgcgacgacggccccgtggacgaggtactcggagtggagtggggattggatcgacggtcccttaacgaaacggaaacacgagtactatacgggacaacgaaccctcggaagggcaaacgtacttaccgaacctagacggaaacccgagtaaacgaaccaaacgtaaactaaaccgaaacgaaacctaacgaaccggtacctaaacgagttaggggaacgggttaggaacgggacgtaccgtaagggaagtaacgttaggtacggtaaaccggaacggaccggggtaccgtttaagttaaacgttttaacggttgggttaccgggaaacggaaaggggttcgggttaaccgggggaacggttggggaacggttaaggggttaacgggggtaaacctttaaacggttaaccggtaaaaacctttaaaacggtttaaacccttttaaaaacgg

SEQ ID NO: 363985 - DNA, 628 bp, Homo sapiens
  misc_feature: GZ8MTXP02IE09N.13.86.H09.1.454.CMB.2.raw
  modified_base (272)..(272): a, c, t, g, unknown or other
  modified_base (283)..(283): a, c, t, g, unknown or other
  modified_base (558)..(558): a, c, t, g, unknown or other
  modified_base (595)..(595): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctcgagtgaagacttctcctgcaaggtcttctggttacactttagctagctatctancagcgtgggtncgacgacggccctaggacgaggacgtcgaggtacggagtggagtggactcgaacgtacccgttaaacgaaacggaaacacgagtaaacctacgtacgaacctaaacggtaacccgttaccgagggggaccaaagtacgttaccgaaaccgtacgtaagaacccgaaacacgaaacactaacgaacaaccgaaactaccgacgacctacgagacggaggtacgaggacgtacgtagagtatacgtagacgacgacggtcttagtacttaggttganacgggagtaaaggtggacgtggacgtaggaacgttanaacgttacaaagttaaccttaatacgtttaaag

SEQ ID NO: 363986 - DNA, 669 bp, Homo sapiens
  misc_feature: GZ8MTXP02H7C4A.13.86.H09.1.454.CMB.2.raw
  modified_base (237)..(237): a, c, t, g, unknown or other
  modified_base (290)..(290): a, c, t, g, unknown or other
  modified_base (307)..(307): a, c, t, g, unknown or other
  modified_base (354)..(354): a, c, t, g, unknown or other
  modified_base (438)..(438): a, c, t, g, unknown or other
  modified_base (469)..(469): a, c, t, g, unknown or other
tcagtcacgtactacacgaccggtgctcgatttagtgctatagacttgggtttggggcacccaaaaaccacacccctccttgggagaatcccatagatcacagctcctcaccatggactggacctggagcattcctttttcttggtggcagcagcaacaggtcgcccactcccgaggttcagctggtgcagtctgcagctggagtagaagagccgtggggcctgagtgaagatctcngacaggtcttcgttggttactacctttgctgtctatcttatcgagtcggtggnaccgcgccggtacccgngggaaccgaggtaccgtggaaggtgggtaagtggggtagtcggtacngtacccgtaacccgtaaaccgaaacggaaacccagtaaccgagtaacgacgacgaaccgtaccgacggacggacgacgttaccncccgaaatacgaccgaacacgacgtacaaanaactaaccgaaccgaacacgtacacgtaagaggtggaaggtggaacgacgttagagtaacgtagtaacgcgtaaccgacgtaaccgggtacgtttaaggttacgtcggtaggacggtaacggtgggtacggttaggtccggtagaacgggtacgttaaagtaacgttaaccgaaacgttaaaacgtttaaacggttaacg

SEQ ID NO: 363987 - DNA, 755 bp, Homo sapiens
  misc_feature: GZ8MTXP02HV672.13.86.H09.1.454.CMB.2.raw
  modified_base (218)..(218): a, c, t, g, unknown or other
  modified_base (426)..(426): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagagccgtggggcctnagtgaagatctcctgcaaggtctttcgtggttacctactttagctagtcttatcttatcgagtcgtgggtcgccgacgacggtccccgtagggaacgaggtacgttacggaggttgggaaggttggggagtagggtactacgtaccgtacccttaaacggaaaaccggtaaacacgtaacgacgttacgacggaactacggtaacccncgggacggagacgtactaccaacctagtacgaacgaacaacgaaccgaaactaaacgtaacccgaaaccgaaaccgaccgaaccggtaacccctaaaaggacggttaacgggaaaggggtacgggaaaacgggacgttaccggtaggaaacgttacgtaaagaacccgggtacccgaaacccgggtaccgggtaccggttttagaaacgttttaggtaccggtagggtacggtaaggtaggggtacggtaggggtcgtaaacgggtaggtaacgttaaacgtaccgtaacgtaaaactttaaaacgtttacggttaaaactttaaacgg

SEQ ID NO: 363988 - DNA, 703 bp, Homo sapiens
  misc_feature: GZ8MTXP02FR4UN.13.86.H09.1.454.CMB.2.raw
  modified_base (219)..(219): a, c, t, g, unknown or other
  modified_base (294)..(294): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctggaggtgaagagccgtggggcctnagtgaagatctcctgacaaggtcttcgtggttacctacctttagctagtcttattcttatcgagtcggtgggtcncgaccgcggccccgtaggacggagtcgtcggaggtggtagtgggatggactcgacgtaccctaaagaaacggaaacacgaagtactagacggaaacacgtaacccgtcggagggactacgtacttaccaccgtaagtaccggaacaaacgacaaaccaacgaaacgtaacccgaaacgaaaccaaccgtaacgtacccctaaagtagggttacgggaaggggaacggacgggaccgtacgttaagggaagttaacgtaaccggtacggaaccggaaccgtacgggttaccgttagtttagttaacgtttggacggtagtaggggtaaggtaggtacgggtacgaggtttaagggaagttaacggtaacgttaaccggtaaactaaaacgtttaacctaagttttaaacg

SEQ ID NO: 363989 - DNA, 725 bp, Homo sapiens
  misc_feature: GZ8MTXP02I3CMG.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgagtgaagagccgtgggcctgagtgaagatctcctgctaaggtcttcgtaggttactacctttagctagcttagtcttatcacgtcgtggtgaccgacgacggccccgtgggacgacggtacgtccggtaggtcggtagtggggtagtacgggtataccgaccgtaccccttaacgaaaaccggtaaacaaccgacgtaccgtaagtacggaacgtaaccgtaacccgtccggacgggacctagtaccgttaccacgtagtacgaaacgacaacggaacaacgtaacaacccgaaacgaaccaacgtaacgaccccgttagacggtaacggggagggttaacgacgggtacttaccggagggtaacgtaacgtacggtaccggaacggaaccgtacgggttacccgtagtttaacgttacggttcggtaggttacggaagtacgggttacgggaacggttcgggaacggtaaggttacgggtaaagttaccggtaacggtaaacttaaaccggtttaactttaaacccg

SEQ ID NO: 363990 - DNA, 867 bp, Homo sapiens
  misc_feature: GZ8MTXP02FLZVY.13.86.H09.1.454.CMB.2.raw
  modified_base (271)..(271): a, c, t, g, unknown or other
  modified_base (279)..(279): a, c, t, g, unknown or other
tcagtcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcgagtgaagatctcctgcaaggcttctggttacacctttagcagctatctatnagctggtncgacacggccccgtggacgagactcggagtggagtgggatggactcgacgtaccccttaaacgaaaccggaaaactaccgaagtaacctaagtacgggaaacctaaacggtaaacccctcccggaaacgggggactaaaacggtaacgtttaaccaaacccgtaaagttacgggaaaacccgaaaccgtaaaaggaaaacccaaaaccgtaaaacttaaaaccccgaaaaccgggtaaaaaccctaaccgaaaacggtaccccctttaaaaacggaaggttaaacgggggtaaacggggttaaagtaaacgggggtaaacccgtacccgggttaaagggaaaacggttaaactaacgggtaaacgggtaaacccgggtaaaccggtaaacccggggttaccggtttaaacggtttaaacgttttaacggtttcggttaacgggtaaccggggttaaaacgggttaaaccgggggttagggggtaaacggggttaccggggtaaaggtaaacggggttaacgggtaaaacggttaaaaccggttaaaccgggtaaaaacctttaaaaacgttttaaaccgtttaaaacg

SEQ ID NO: 363991 - DNA, 683 bp, Homo sapiens
  misc_feature: GZ8MTXP02JUD2G.13.86.H09.1.454.CMB.2.raw
tcagtcacgtactacacgaccggtgctcgatttagtgctatagacttgggtttggggcacccaaaaaccacacccctccttgggagaatcccctagatcacagctcctcaccatggactggacctggagcattcctttttcttggtggcagcagcaacaggtgcccactcccaggttccagctggtgcagtctgcagctgaggtgaagagccgtgggcctgagtgaagatcctcctgaccaaggtctttcgtggttacctaccgtttagctagtaccttatacttatctagtcggttcgggtcgaccggaccgtaccgggtccccgtagggaccggaggtaccgttggaggtaggtaggtagggtagtaggtactaccgtaaccggtacccttaaaaccgaaaacggtaaaccaaccggtaacgtaaccgttaggtaacggaaccgaaccgtaacccgtcggacggaactacgtaactacccgaactagtacggaaccgacaacgaaccaacgacaaacccgaacgaaccacgtacgtaccgttaagaggtacgggagtacggagacgctaggattacgaagacgacgacgtacgtgtagttagttgaggtgaggtaaggcgttagggcgtaggacgtaaggtacgaagttaccgaaacgtaacctttaagtaaccgtttaag

SEQ ID NO: 363992 - DNA, 651 bp, Homo sapiens
  misc_feature: GZ8MTXP02F1RIS.13.86.H09.1.454.CMB.2.raw
  modified_base (229)..(229): a, c, t, g, unknown or other
  modified_base (234)..(234): a, c, t, g, unknown or other
  modified_base (236)..(236): a, c, t, g, unknown or other
  modified_base (386)..(386): a, c, t, g, unknown or other
  modified_base (455)..(455): a, c, t, g, unknown or other
  modified_base (499)..(499): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtagaagacgccgtgggcctcagtagaagntctcngnaggtcttcgtgttactaccttagcagtacttatccttatcaggtcgtggggtagccggaacgtaccggccccgtagggaccggtagacgtacggtaggtgggaacgtggggagtgacctcgacggttaccctaaacgaaacgaaacctanaccgactagtacggaactacgaacccgtacgcgggactaacgtactaccgaacctaagtacgaccgaanaacgtaccaacaacaaacaaaccgaacgacgactaacccgtaanagagggaggtaaggacgggtacgtacgtgaaacgtataccgagaacggacgtacgggtctagttagtttagccggttagaggtaggacggttggaagttaggcgttagaagggtacttaacgaacgtagttaaaactaccttaagtttaacg

SEQ ID NO: 363993 - DNA, 539 bp, Homo sapiens
  misc_feature: GZ8MTXP02F9WJP.13.86.H09.1.454.CMB.2.raw
  modified_base (281)..(281): a, c, t, g, unknown or other
  modified_base (447)..(447): a, c, t, g, unknown or other
  modified_base (478)..(478): a, c, t, g, unknown or other
  modified_base (494)..(494): a, c, t, g, unknown or other
tcagtcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagccgtggggcctcagtgaagatctcctgcaaggcttctggttacaccgtttagcagctatcttatcagctgggtncgacaggcccctggacgagctcgagtggatgggatggatcagcccttaagaaacggaaacacacgactagtagaacagaaccctcgagggcagactccacatcgacacagaacacactacaacgaacacacgactacagtcgaggtgacggagtccagagatacgngacgaacgacggcctagtattagtgcgtagnggaagtggagtacggngtaaggaacgtagacgttaacgaataaaacgttacctaagttaaa

SEQ ID NO: 363994 - DNA, 519 bp, Homo sapiens
  misc_feature: GZ8MTXP01EB032.52.18.B07.1.454.CMB.2.raw
  modified_base (258)..(258): a, c, t, g, unknown or other
tcagcgcagtacgacacgaccggtgctcgatttagtcgctgcgtaaaggaggaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctacactagattagcctggtancagcaaaggaaccggggagacgacccctaaactcctagactccatactgcatccactttgcatgctggggtcccattcgaggttcggcgcaagtgaatcgtgggacagaattcactctcacaatcagcagcctgcagactagaagactccgactaatttactactgtacaacaacgtacacccgttaccatccacctcggaaccaagggacacggcgtaggaagttaacttaaacgacgtgtggctgcacctaattcgttc

SEQ ID NO: 363995 - DNA, 698 bp, Homo sapiens
  misc_feature: GZ8MTXP01E0LZN.52.18.B07.1.454.CMB.2.raw
  modified_base (319)..(319): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtcctgcatcgtggtgggggacagagtcaccatcacttgccggacagtgaggacatctacactagattagcccgtagtacagacgaacgaaacgggaacggacgacccgtaaaccctaactcgatactacattacncactctaccttagttcatgtcgtcgggtccggtaccttagtcggtacggtcggccgtgtaaggtagtcgtagggacggtaacaattactactacttactaacaaatacggacacgactaccgtaccgaggacacgtaacgaaaggaccgtaccgtacccttaaatttaaactttttaccggactttaaccaaaaccgtaaacccgttaccccgtaaccgttaaacccccggtcttaaccgtaccccgttaccggtaacccggaaacgggaaccggttacccggaggttacccgtaaagggtaaacccgtttaaaacggttaaaccgttagttcggggaccgttaacgaccccgacttaaccttctttcggtttaacccg

SEQ ID NO: 363996 - DNA, 592 bp, Homo sapiens
  misc_feature: GZ8MTXP01AV212.52.18.B07.1.454.CMB.2.raw
  modified_base (257)..(257): a, c, t, g, unknown or other
  modified_base (276)..(276): a, c, t, g, unknown or other
  modified_base (365)..(365): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcacatcacttgccgacagtgaggacatctacactagattagcctggtancagacaaggaaccgggganacgacccctaaatcctgactccatactgacattccactttgctagtcgcgtcggggtccctagttcgaggttcggcgtacgaagttggntcgtagggactagtaattcactctacacatcagcagctgacagtacagaacgacctacgacttaaatttcgtaactacgtacctaaaccgaccgttaccgtaacccggttaccctacttacccgtacccgttcgggaacccgaaacggggccgacgggttacgtaaggaacgttaaaacgttaaccgaacgttggtcgtccgtacgaccttactcgttaacctttcg

SEQ ID NO: 363997 - DNA, 594 bp, Homo sapiens
  misc_feature: GZ8MTXP01CYM8E.52.18.B07.1.454.CMB.2.raw
  modified_base (257)..(257): a, c, t, g, unknown or other
  modified_base (276)..(276): a, c, t, g, unknown or other
  modified_base (369)..(369): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcacatcacttgccgacagtgaggacatctacactagattagcctggtancagacaaggaaccgggganacgaccccctaaatccctagactccatactgacattccaacttttgctagtcgacgtggggtcccctagttcgagggttcggcgctaaggtgntcgtaggggactagtacttcactctacactaatcagcagcctgacagactagaacgtactccgattaaactttatactacgtaccaaactaaccggtacctaaccccggttacctactacccaccgttccggaaccgtaaagggccgtaccgggcgtaacggaagttaaacgttaaaccgacgtttaacgggcggtcttacggacccttaaccttcgttcgttcg

SEQ ID NO: 363998 - DNA, 609 bp, Homo sapiens
  misc_feature: GZ8MTXP01CZU7H.52.18.B07.1.454.CMB.2.raw
  modified_base (263)..(263): a, c, t, g, unknown or other
  modified_base (284)..(284): a, c, t, g, unknown or other
  modified_base (384)..(384): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtcctccattccttcctgtctgcatcgtggtggggacagagtcaccatcacttgccggacagtgaggacatactacactagattagcctaggtancagacgaaaggaaccgggganacgaccccctaaatcctagactaccatacctgactactccctaacttttgctagtcgtcgtcggggtcccctagttcgaggttcggcggcgaaggttggntcgtaggggaactagtacttcactctacacaatcagcagctgacgagactagaacgtactccgtattaactttaattactacgtaaccaaacctaaccgttacctaacccgttaacccgtactaccgtacccgttcgggaaccgaaacgggaccgtacggacgtaacgggaagttaaacgttaaacgacgtggtacggtctcgaccttacctaattcgtttaacg

SEQ ID NO: 363999 - DNA, 544 bp, Homo sapiens
  misc_feature: GZ8MTXP01A16C4.52.18.B07.1.454.CMB.2.raw
  modified_base (257)..(257): a, c, t, g, unknown or other
  modified_base (361)..(361): a, c, t, g, unknown or other
  modified_base (413)..(413): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctagctcccaggtgccagatgtgacatccagttgacccagtctccatccttcctgtctgcatcgtggtggggacagagtcacatcacttgccggacagtgagacatctacactagattagcctggtancagcaaggaaccggggagacgaccccctaaatcctagactcccatactgcatcccatttgcagtgcgtcggggtccctagttcgaggttcggcggacaggttgntcgtagggacagtacttcactcacagaatcagcagcctgcagactagaaacnctccgattaatttatactgtaaccaaacgtacgtaccaccggttaccatccgaccgttcggccgaaagggccgagggttcctaggggaaacttagttaaaccgagtggtgctcgacactaacgttcgttcg

SEQ ID NO: 364000 - DNA, 649 bp, Homo sapiens
  misc_feature: GZ8MTXP01B050L.52.18.B07.1.454.CMB.2.raw
  modified_base (255)..(255): a, c, t, g, unknown or other
  modified_base (276)..(276): a, c, t, g, unknown or other
  modified_base (433)..(433): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcaccatcacttgccgacagtgagacatcacactagattagctggtancagacgaaaggaaccgggganacgacccctaaatcctagactcccaatacctgacactcctactttgctagtcgcgtcggggtccctaagttccgtagggttccggcggtacgtaagttaggaatcggtaggggaacctaaaggtaactttcaacttcacaacaatcagcaagtcccngaccagacagaactacgtaccgattaaattttacttactacgtaacaaaccgtaaaccgtcctaaaaccccggtttccgaacttacccctaaccgtttccgggaacccgaaacggggttaccggaaccgttaccgttaaggggaaaacttaaacgttaaaaccggaaaccgttgggttacggccttacggacccttaaacccgttcgttccgttcg

SEQ ID NO: 364001 - DNA, 636 bp, Homo sapiens
  misc_feature: GZ8MTXP01ECDX5.52.18.B07.1.454.CMB.2.raw
  modified_base (257)..(257): a, c, t, g, unknown or other
  modified_base (278)..(278): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcaccatcacttgccgacagtgagacatctacactagattagcctggtancagacgaaaggaaccgggganacgacccctaaatcctagactccatactgactactcctactttgactagtcgcgtcggggtccctagttccggagggttcggcggtctaaggtggaacgtcggtagggactaggtaacttcacttctacaactaatcagcacgtcctagacagacgtacgaactaccgtaccctaattaaattttacttaccttacgtaacctaaaccgtaacccggttacctaaaccccggttacctacttacccgtaccgttcccgggaaccgaaagggaccgacgggttacgtagggtaaacgttaaaacgttaaccggaacgttgggtacggtcttcgaccttacctaacgtttccgttaaccg

SEQ ID NO: 364002 - DNA, 592 bp, Homo sapiens
  misc_feature: GZ8MTXP01DR3U7.52.18.B07.1.454.CMB.2.raw
  modified_base (260)..(260): a, c, t, g, unknown or other
  modified_base (284)..(284): a, c, t, g, unknown or other
tcagcgcagtacgacacgaccggtgctcgatttagtcgctgcgtaaaggaggaaagggggggggtcagtcccagtcaggacacagcatggacatgagggtccccgctcagctcctggggctcctgctgctctggctcccaggtgccagatgtgacatccagttgacccagtctccatccttcctgtctgcatcgtggtgggggacagagtcaccatcacttcgccggacagtgagacatctacactagattagctggtancaagacgaaacggaaaccgggganaaccgtacccctaaactccctagactcccaatactcgactacttcctactttgctagtcgtcgtcggggtaccctagttccggtagggttcggcgacgaaggtggaactcgtagggaacagtaactcactctacaacatcagcagcctgactagacgtagaacacgtcctaattaatttactactacgtacaaactaccgtacctaacccgttaccactcctaccgtccgggaacgaacgggaccacgggacgtagggaacttaaacgttaaacgttactggtcgaacttgaccttactcgttcttcg

SEQ ID NO: 364003 - DNA, 621 bp, Homo sapiens
  misc_feature: GZ8MTXP01B6HL2.52.18.B07.1.454.CMB.2.raw
  modified_base (261)..(261): a, c, t, g, unknown or other
  modified_base (283)..(283): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccattccttcctgtctgcatcgtggtgggggacagagtcaccatcacttgccggacagtgaggacatctacactagattagcctggtancagacgaaagggaaccgggganaccgacccctaaactcctagactccatactgacctactcctactttgctagtcggtcgtcgggggtccctagttcggacgggttcgggcggcgtaaggtggaacgtcggtagggactaggtaacttcactcctacaacaactcagaccacgtaccctggactaacgactacgaacgtactacccgtattaacttttattacctacgtaaccaacctaaccgtacctaacccgttacccgtacttccctaaccgttccggaaccgaacgggacgacgggcgtaaggaacgttaacgttaaacggactggtcgggtctcgacttacctaagttcttaacg

SEQ ID NO: 364004 - DNA, 595 bp, Homo sapiens
  misc_feature: GZ8MTXP01B9GVN.52.18.B07.1.454.CMB.2.raw
  modified_base (260)..(260): a, c, t, g, unknown or other
  modified_base (381)..(381): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttcgacccagtctccatccttcctgtctgcatcgtggtggggacagagtcaccatcacttcgccggacagtgagacatctacactagattagcctggtancgagacgaaacggaacggggagacgacccctaaactcctagactcccatactgacactcctacttttgactagtcgtcggtcggggtaccctagttccggagggttcgggcgcgtaggtgntcgtagggacagtaactcactcacaacatcagcagcctagacagactacgaacgctaccgtacttaatttactactacggtaactaaccgtaccgtacctacccgttaccgtaccttccgacccgttccgggaaccgaacgggaccgacggacgtagggaacttaaacgttaaacgaggttaacggcggtctcgaccttacgtcttcgtttccg

SEQ ID NO: 364005 - DNA, 614 bp, Homo sapiens
  misc_feature: GZ8MTXP01BCV48.52.18.B07.1.454.CMB.2.raw
  modified_base (281)..(281): a, c, t, g, unknown or other
  modified_base (380)..(380): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcaccatcacttgccggacagtgagacatctacactagattagcctaggtatcgagacgaaaggaaccgggganaccgacccctaaactcctagactccatactgactactcctactttgctagttcgcgtcggggtccctagttccggagggttcggcggcgtaaggtggtntcggtaggggaactagtacttcactctacacaatcgacgcacgtcctgacacgactagaacgtacctacccgtattaaacttttactaccgtacgtaaccaaaccgtaccgttacccgtaaacccgttacccgtacctaccgtacccgttccgggaaccgaacgggttaccgacggcgtaaggtaacgttaacgttaaacgacgtggcgtcgtcgaccttacctaattcgttcg

SEQ ID NO: 364006 - DNA, 581 bp, Homo sapiens
  misc_feature: GZ8MTXP01B8BV0.52.18.B07.1.454.CMB.2.raw
  modified_base (366)..(366): a, c, t, g, unknown or other
  modified_base (402)..(402): a, c, t, g, unknown or other
  modified_base (562)..(562): a, c, t, g, unknown or other
  modified_base (581)..(581): a, c, t, g, unknown or other
tcagcgcagtacgacacgaccggtgctcgatttagtcgctgcgtaaaggaggaaagggggggggtcagtcccagtcaggacacagcatggacatgagggtccccgctcagctcctggggctcctgctgctctggctcccaggtgccagatgtgacatccagttgacccagtctccattccttcctgtctgcatcgtggtggggacagagtcaccatcacgttcgaccggacagtgagacatctaacactagattacgctggactcaagacgaaaggaaccggggacacgtaccccctaaactcctaggactaccaatacgtcgactacttcctactttggctagtcgtcgtcgggtcctagttcgnggttcggcgtcaagtgaatcgagggactatactcancgtacaataactcagccacgtcacgacgacgacgacgaacgacgtaccgtacgttaactttaacttaactacgtactaacctaaccgtaccgtacccggtaacctactacctaccgtcgaacgaacggacgacgcgtagagttaacgttacgacgtaagngtcgcacactaacgttgtn

SEQ ID NO: 364007 - DNA, 638 bp, Homo sapiens
  misc_feature: GZ8MTXP01EQQP6.52.18.B07.1.454.CMB.2.raw
  modified_base (259)..(259): a, c, t, g, unknown or other
  modified_base (281)..(281): a, c, t, g, unknown or other
  modified_base (301)..(301): a, c, t, g, unknown or other
  modified_base (311)..(311): a, c, t, g, unknown or other
  modified_base (403)..(403): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttcgacccagtctccatccttcctgtctgcatcgtggtggggacagagtcaccatcacttgccggacagtgagacatctacactagattagcctggtancgagacgaaaggaaccgggganaccgacccctaaatccgtanactccatacngactactctactttgctagtcgcgtcgggtcctagttcggaggtcgcgtcaaggtgtgtcgtagggaactagtaacttcactctacaactancgagacacgcctagacagacgttacgaacgtaccttaccgaatttaacttttacgtaacttaacgtaactaaacccgtaaccgtacccgttaaacccggttaaccctcgttaacccgtacccggttaacgggaacccggtaaagggttccgaaccgggttacgtaacgggtaaacgttaaacgttaaacgggttacttgggtcgtcgttaccgaccttactcgttaaccgttccg

SEQ ID NO: 364008 - DNA, 597 bp, Homo sapiens
  misc_feature: GZ8MTXP01CXYNX.52.18.B07.1.454.CMB.2.raw
  modified_base (258)..(258): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctacactagattagctggtancagcaaggaaccggggagacgacccctaaactcctagactccatactgcatcctactttgcctatcgcgtcgggggtcctacgttccgaggggttcggcggtccgaaggttgggtaacttcggtacggggactaaggtaacttctaacctctactaacaactcgacgcacgctgacagactacgaacgacctaccgagttaactttacttactacgtacaacgtaaccgttccgaacccgtttaccactaccgtacccgttacggaacccgaagggttaccgacggcgttaaggcgttaaagttaacggaactggtacggctgacacctaagttcttcg

SEQ ID NO: 364009 - DNA, 595 bp, Homo sapiens
  misc_feature: GZ8MTXP01ASLMK.52.18.B07.1.454.CMB.2.raw
  modified_base (258)..(258): a, c, t, g, unknown or other
  modified_base (281)..(281): a, c, t, g, unknown or other
  modified_base (296)..(296): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttcgacccagtcctccatccttcctgtctgcatcgtggtggggacagagtcacatcacttgccgacagtgagacatctacactagattagcctggtancgaagacgaaaggaaccgggganaaccgacccctaaanccctagactaccatactcgactacttcctactttcgacagtcgtcgtcggggtaccctagttccggagggttccggcggcaagggtgaacgtcgtagggactagtaacttcactctacacaatcagcagacctgacagacgtacgaactacctacgtaacttaattttactactacgtaaccaaaccgtacctacctaacccgttaccactcccgtaccgtacggaaccgaaggactcggagtaggaacgttaacgttaacggactggcgaacgtacgaccttaactcttcgtttaacc

SEQ ID NO: 364010 - DNA, 615 bp, Homo sapiens
  misc_feature: GZ8MTXP01DTWM9.52.18.B07.1.454.CMB.2.raw
  modified_base (257)..(257): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttcgacccagtctccatccttcctgtctgcatcgtggtggggacagagtcaccatcacttgccggacagtgagacatctacatagattagctggtancagcgaaggaaccgggagacgacccctaaatcctagactccatacgtgactatcctactttgctagttcgtacgtggggttcccctaagttccgaagggttcggaagtcgtaaaggtggtaacgtcggtagggaacaaggtaacttccaacttctacaactaactcaaggcacgtactgacgtagacacggaactactcccggaatttaaactttattaaccgtacgttaaccaaacgtaccttaccgtaacccggttaccctatcccgtaaccgttccggaacaaggggaccacggttacgtaaggacgttaaacgttaacgacgttgacgcttgaccttactaacgttcgttaacc

SEQ ID NO: 364011 - DNA, 739 bp, Homo sapiens
  misc_feature: GZ8MTXP01C01LA.52.18.B07.1.454.CMB.2.raw
  modified_base (259)..(259): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttctgtctgcatcgtggtggggacagagtcaccatcacttgccggacagtgaggacatctacactagattagcctaggtancagcgaaaggaaccgggagacgacccctaaactcctagactaccatactgctactcctactttcgctagtcgacgtcggggtaccctagttccgtagggttcggcggtacgtaagggttcgaacgttccgttagggggaactaaggtaacttaccgtacttaccttaccaaactaactaccgacggaccgaaccgtcccgttagaaccgaacggtaaccgttacggaaaaccggtacctttaacccggtaacgtttaaaacggtttttaacctttaaaccgttaccggtaaaccctaaaaccgtaacccggttacccgttaaaccccggtttaaccccggtaacttaccccgttacccgttacccggggaaaccccgtaagggggaaccccgtacgggccggttaaacgggaacgttaaaaccgttaaaccggacgttcgggtacggtccttaggacccaccgttaacgttctttaaccg

SEQ ID NO: 364012 - DNA, 734 bp, Homo sapiens
  misc_feature: GZ8MTXP01DLWQU.52.18.B07.1.454.CMB.2.raw
  modified_base (259)..(259): a, c, t, g, unknown or other
  modified_base (280)..(280): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcacatcacttgccggacagtgaggacatctaacactagattagctaggtancagacgaaaggaaccgggganaaccgacccctaaactcctagactccatactgactactcctactttgctagtcggtaccgttcgggggtacccctaagttccggtacggggtttccgggccggtaccgtaagggttagggtaacgtccgggtacggggaaactaaggtaaactttccaacttccttacaaactaactcgacgaccgacgtacccgtagacgtaacgaacgttacgaaacgtaccttacccgtaatttaaacttttactttaaaccgtacgtaaccctaaaccgtaacccgttcctaaaccccggtttacccgtaacttacccgtaacccgttccgggaaacccggaaacggggttaccgaaccgggttcgttaaacgggtaacgttaaaaccgttaaacggttaaacgttccgggttaacggccgttaaccggacccgttaaccttaacgttccggtttaaccg

SEQ ID NO: 364013 - DNA, 574 bp, Homo sapiens
  misc_feature: GZ8MTXP01AKOWB.52.18.B07.1.454.CMB.2.raw
  modified_base (258)..(258): a, c, t, g, unknown or other
  modified_base (276)..(276): a, c, t, g, unknown or other
  modified_base (360)..(360): a, c, t, g, unknown or other
  modified_base (388)..(388): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggaccagtgaggacatctacactagattagctggtancagcaaaggaccgggganacgacccctaaatcctgactccatactgacatccatttgctatgcctcggggtccctagttcgagggttccggcggctagtggntcgtagggaacagtaattcactctacanatcagcagcctgcagactagaactacctcgtactaatttacttactacgtaaccaacgtaaccgtacctaacccgttacccgtacgtacctaccgttccggaaccgtaacgggacgtaccggcgtaaacggtaacgttaaacgttaaacgaacgtggtcgtcgtacacacctaacgttcttaaccg

SEQ ID NO: 364014 - DNA, 527 bp, Homo sapiens
  misc_feature: GZ8MTXP02ILT8T.52.18.B07.1.454.CMB.2.raw
tcagcgcagtacgacacgaccggtgctcgatttagtcgctgcgtaaaggaggaaagggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacaggagtcaccatcacttgccggacaggtgaggacatctacactagattagcctggtatcagcaaaggaaccggggagacgacccctaaaactcctagactccatactgcaactccactttgcatgcgtggggtcccagttcgagggttcggcggcaggtggatcgtggaacagtaacttcactctacacaaatcagcagcctgacaagactagaacgactccgactaaatttattactgtacaaacacgtacaaccgttaccatcacctacggactaagggacacgcgtagacgtaataaaccgatgtagctagcacactcttcg

SEQ ID NO: 364015 - DNA, 618 bp, Homo sapiens
  misc_feature: GZ8MTXP02HDR3W.52.18.B07.1.454.CMB.2.raw
  modified_base (277)..(277): a, c, t, g, unknown or other
tcagcgcagtacgacacgaccggtgctcgatttagtcgctgcgtaaaggaggaaagggggggtcagtcccagtcaggacacagcatggacatgagggtccccgctcagctcctggggctcctgctgctctggctcccaggtgccagatgtgacatccagttcgacccagtcctccatccttcctgtctgcatcgtggtggggacagagtcacatcacttgccgacagtgagacatcacactagattagcctggtatcagacgaaaggaaccgggganaccgacccctaaactctagactaccaatactgactacttccctaatttcgactagtcggtccgtcggggtaccctaacgttcggacgggttcggcggtacgaggttgagtcgtaggggaacctaagtacttcacttcacaactaatcagcacgctgacaagactaggaacacctacgtaacttaattttactagttacgtaaacaaacctaccgtacctaaccccgttaaccgctacccgtaccgttaccggaaccgaacggggcaccggtagttaacgggaaataaacgttaaacccgagttcggacggttaccgtacgacctacctactttcgttaccg

SEQ ID NO: 364016 - DNA, 604 bp, Homo sapiens
  misc_feature: GZ8MTXP02JE7HN.52.18.B07.1.454.CMB.2.raw
  modified_base (281)..(281): a, c, t, g, unknown or other
  modified_base (310)..(310): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttggccggacagtgaggacatctacactagattagcctggtatcagacgaaaggaacccgggganaacgacccctaaatcctagactccatacngacactccctatttgactagtcgacgtcggggtaccctagttcgacgggttccggacggtacgtaggtggacgttcggaggggaaccagtaacttcaactctacaactaatcagaccagtcctggacaacgactagaacgtacctccgtaacttaaacttttatacgtagtaccaaacgtaccgtacctaacccggttaccacttacctaccgttcggaccaaagggccacggtactacgggaactaaaacgttaaccgaagtggtacggtacgtacacaccgttactcttacg

SEQ ID NO: 364017 - DNA, 674 bp, Homo sapiens
  misc_feature: GZ8MTXP02F5FD9.52.18.B07.1.454.CMB.2.raw
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtgggggacagagtcaccatcacttgccggacaggtgaggcatctacactagattagcctaggtatcagacgaaaggaacggggagacgacccctaaaactcctagactccaatactcgctactctacttgctagtgcgtcggggtccctagttccgtagggttcggcggtacgaggtggacgtcggtagggaactaagtaacttcaaccttctacaactaaactacgacgccgtaacgcctacgacaacgtacgtaacgaaaccgtacctaccgtaaacttaaacgtttacttaccttaggtaaacctaaaacccgtaaccgttacccgtaaacccggttaacccgtaacttacccgtaacccgttaccgggaacccggtaaacgggtaaccggaccgggtaacggtaagggtaaacgtaaaacgttaaacgtaaaacgtcggtacggtacgtacgacctaacccgtatactttaccg

SEQ ID NO: 364018 - DNA, 519 bp, Homo sapiens
  misc_feature: GZ8MTXP02ID1B0.52.18.B07.1.454.CMB.2.raw
  modified_base (381)..(381): a, c, t, g, unknown or other
  modified_base (391)..(391): a, c, t, g, unknown or other
  modified_base (496)..(496): a, c, t, g, unknown or other
tcagcgcagtacgacacgaccggtgctcgatttagtcgctgcgtaaaggaggaaagggggggtcagtcccagtcaggacacagcatggacatgagggtccccgctcagctcctggggctcctgctgctctggctcccaggtgccagatgtgacatccagttgacccagtctccatccttctgtctgcatctggtgggggacagagtcacatcacttgccggacagtgaggacatctacactagattagcctggtatcagacaaaggaaccggggagacgacccctaaactcctagactccatactgcatcctatttgcatgcgtcggggtcctattcgtagggttcggcggctaggtgatcgtaggacagtaattcactcncacaatcgancagtcctgacagactgaaacgacctcgactaattttatactgtacaacgacgtacaccgttaccgatccacgtcggacaaggcacggctagaacgtacttaaacncgtgtgctagacacctatcctcg

SEQ ID NO: 364019 - DNA, 760 bp, Homo sapiens
  misc_feature: GZ8MTXP02IY4Z8.52.18.B07.1.454.CMB.2.raw
  modified_base (278)..(278): a, c, t, g, unknown or other
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccgacagtgagacatctacactagattagcctggtatcagacgaaaggaaccgggganacgacccctaaactcctagactccatacctgcctactccctactttgctagtcggtccgtcggggttacccctagtttccggaggggtttccgggcggtcgtaagggttcgggacgttccggtagggggacctaagtaaactttccacttaccctacaactaactacaacgtccacgtaccctaggacctaacggtaacctaacgggaaacgtacccgttacccgttaaacttaaactttttacgttaacccgttacggtaaaccctaaaacccgtaaacccggttaccccgtaaacccccgggtttaaaaccccgtaccgtttaaccccgtaaacccggtttaccccgggaaaacccgggtaaacggggtaacccgaacggggtaccggttaacggggtaaacgttaaaacgttaaaaccggtacgttaacgggtcggggtacttaccgggacctaaacccggtttactttaccgtttacg

SEQ ID NO: 364020 - DNA, 614 bp, Homo sapiens
  misc_feature: GZ8MTXP02HOVRM.52.18.B07.1.454.CMB.2.raw
  modified_base (291)..(291): a, c, t, g, unknown or other
tcagcgcagtacgacacgaccggtgctcgatttagtcgctgcgtaaaggaggaaaggggggggtcagtcccagtcaggacacagcatggacatgagggtccccgctacagctcctggggctcctgctgctctggctcccaggtgccagatgtgacatccagttcgacccagtcctccattcccttcctgtctgcattcgtggtgggggacagacgtcaccatcacttcgaccggactaggtgagacatctacactagattagcctggtatcagacgaaaggaaccgggganaccgacccctaaactctagactccatactcgctactcctatttgctagtcgtcggtcggggtcctagttcggacgggttcggcggtacgtaggtgggtactccggtagggaactagttaacttccaactcctaactacaaactccgagccagtctaggacacgtacagaacgtctaccgtattaatttacacgtacgtacaaacgtaccgtacctacccttaccgtactacccgtaccgtacggaaccgtaacggcgaacggtcgtaaggtaacgtaaccttaaacgcgtaacggtacgctacgacaaccttctttccgtacg

SEQ ID NO: 364021 - DNA, 703 bp, Homo sapiens
  misc_feature: GZ8MTXP02G3ORP.52.18.B07.1.454.CMB.2.raw
tcagcgcagtacgacacgaccggtgctcgatttagtcgctgcgtaaaggaggaaaggggggggtcagtcccagtcaggacacagcatggacatgagggtccccgctcagctcctggggctcctgctgctctggctccaggtgccagatgtgacatccagttcgacccagtctccatccttcctgtctgcatcgtggtgggggacaggacgtcaccatcacttcgccgacagtgagacatctacactagattacgctgtatcgagacgaaacggaaccgggacgaaccgtacccctaaacgtcctagactacccaatactcgactaactcctaactttgctagtcgtccgtacggggtccctaagtttccgtacggggttccggccggtagtaaggtcgggtacgttccgggagggggtaaacctaaggttaaccttacctaaccgtttaccctaacctaaacgaaacttaccgaaacggtaccaacgggttcctacggaactaacgaacgtaacgaaacgtaccgtaccgtaacttaaacgttttactaaaccgtagtaaacccaaaacgtaaccgttaccgtaacccgttaacccggacttaccgtaccgttaccggaaccgaacggaaccgtacgggacgttacggaagttaaaacgtaaaccggtaacgtgtacgacgtacaccctactacgtcttaccg

SEQ ID NO: 364022 - DNA, 613 bp, Homo sapiens
  misc_feature: GZ8MTXP02FNKYM.52.18.B07.1.454.CMB.2.raw
  modified_base (230)..(230): a, c, t, g, unknown or other
  modified_base (263)..(263): a, c, t, g, unknown or other
  modified_base (367)..(367): a, c, t, g, unknown or other
  modified_base (427)..(427): a, c, t, g, unknown or other
tcagcgcagtacgacacgaccggtgctcgatttagtcgctgcgtaaagggagaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtgggggacagacgtcaccatcactcggaccgacngtagaggacatctacactagatacgcctggtancagacgaaaggaaccggggacaccgacccctaaatcccgtagactaccatacctcgactactacctactttgctatcgcgtcgggtcctacgttcgagggtcgnggtcccaggtgctcggaggactagtaacttcactctacaacactacacgcacgtctcganaacgacgtacggaactaccgtacctacttaaatttaccttacgtactaaccaaacgtaaccgtacctacccgttacccgacttacccgtaccggtaaccgggaccgaaacggggaccgtacggacggtaacggtaaacgaaacggttaaacgacgtggtacgcgtaacgcctaacgtctctttacg

SEQ ID NO: 364023 - DNA, 249 bp, Homo sapiens
  misc_feature: GZ8MTXP01BXAX1.17.6.A06.1.454.CMB.2.raw
  modified_base (249)..(249): a, c, t, g, unknown or other
tcagcgtagactagcacgaccggtgctcgatttagatctactgacagggccggtgggagctactccacgggccatgaatcgtggggccagggatccctagtcaccgtctcctcagcctccaccaagggcccatcggtcttcccctggcgccctgctccaggagcacctccgagagcacagcggccctgggctgcctggtcaaggactacttccctagtctacgctgagcgggctggcaaggcgcatagn

SEQ ID NO: 364024 - DNA, 252 bp, Homo sapiens
  misc_feature: GZ8MTXP01DJK2J.17.6.A06.1.454.CMB.2.raw
  modified_base (251)..(252): a, c, t, g, unknown or other
tcagcgtagactagcacgaccggtgctcgatttagatctactgacagggggccggtgggagctactccacggggccatgaatcgtggggccagggatccctagtcaccgtctcctcagcctccaccaagggcccatcggtcttcccctggcgccctgctccaggagcacctccgagagcacagcggccctgggctgcctggtcaaggactacttcctagtctacgctgagcgggctggcaaggcgcatagnn

SEQ ID NO: 364025 - DNA, 520 bp, Homo sapiens
  misc_feature: GZ8MTXP01BFWD5.17.6.A06.1.454.CMB.2.raw
  modified_base (225)..(225): a, c, t, g, unknown or other
  modified_base (296)..(296): a, c, t, g, unknown or other
  modified_base (321)..(321): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttanacagctccgacaataagaaatactagctggtaccagcaagaaaccaggacaacctcaagctgctcattacnggcatcgtacccgggatccgggccngaccgattcagtgcagcgggtctgggacagtattcactctacacatcagcagcctgcagctgagatgtgactacgtttatactgtacacctagtttactctatttactcctttcacctttcgggaacgtacggaaaccgtaagggttcgaacgaaccttacgttacgaactggtacgctacgccacctaacgttccttg

SEQ ID NO: 364026 - DNA, 553 bp, Homo sapiens
  misc_feature: GZ8MTXP01D53OI.17.6.A06.1.454.CMB.2.raw
  modified_base (227)..(227): a, c, t, g, unknown or other
  modified_base (240)..(240): a, c, t, g, unknown or other
  modified_base (300)..(300): a, c, t, g, unknown or other
  modified_base (325)..(325): a, c, t, g, unknown or other
  modified_base (331)..(331): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagttgttttanacagctaccgaanaataagaaatactagctggaccagcaagaaaccaggacaacctctaagctgctcattacngggcatcgtaccggatccgggtccngaccgntcagtgcagcgggtctgggacagtatttcactctacaccatcagcagcctgcatgctgagatgtggctactttattacctgtactacctagtttatctattactcctttctcgtttcggcggttaacggtaaacccgttaaagggtacgggaacgacccgttaattaaccggtaaccgtttagggtccgggtaccttcgggaccctaacccgaattttcccg

SEQ ID NO: 364027 - DNA, 253 bp, Homo sapiens
  misc_feature: GZ8MTXP01ED32F.17.6.A06.1.454.CMB.2.raw
  modified_base (253)..(253): a, c, t, g, unknown or other
tcagcgtagactagcacgaccggtgctcgatttagatctactgacaggggggccggtgggagctactccacggggccatgaatcgtggggccagggatccctagtcaccgtctcctcagcctccaccaagggcccatcggtcttccccctggcgccctactccaggagcacctccgagagcacagcggccctgggctgcctggtcaaggactacttcctagtctacgctgagcgggctggcaaggcgcatagn

SEQ ID NO: 364028 - DNA, 254 bp, Homo sapiens
  misc_feature: GZ8MTXP01DCH75.17.6.A06.1.454.CMB.2.raw
  modified_base (251)..(254): a, c, t, g, unknown or other
tcagcgtagactagcacgaccggtgctcgatttagatctactgacagggggccggtgggagctactccacgggccatgaatcgtggggccagggatccctagtcaccgtctcctcagcctccaccaagggcccatcggtcttcccctggcgccctgctccaggagcacctccgagagcacagcggccctgggctgcctggtcaaggactacttccctagtctacgctgagcgggctggcaaggcgcatagnnnn

SEQ ID NO: 364029 - DNA, 703 bp, Homo sapiens
  misc_feature: GZ8MTXP01AU01W.17.6.A06.1.454.CMB.2.raw
  modified_base (225)..(225): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttanacagctccgacaataagaatactagctggtaccagcaagaaaccaggaccaacctcctaaagctgctactatttacgtgggcacgtccgtaaccccggggaagttccccgggggtacccctaggtaacccgtacgtttccgaaggttcgggccgaagggtcccggggttcttggggtacgacgtaagttaccttacctacctacctacccaactactacgacgaccgaccgtcgtacgacggtacgtacggtaagggacgtaggttacgggtaccggttaacctttaacgttttaacgtttaccgttaccgttacccttaacgtttaagttttacctaactttactttaccgtttacctttaccgttaccggttaacgggtacgggttaaaccggtaaacggttacgggtaacgtaacgttaaccgttacgttaacccgtaagttcggtcggtactcggttacctaacgttctttccg

SEQ ID NO: 364030 - DNA, 637 bp, Homo sapiens
  misc_feature: GZ8MTXP01BPHDV.17.6.A06.1.454.CMB.2.raw
  modified_base (231)..(231): a, c, t, g, unknown or other
  modified_base (244)..(244): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgccgtacggggacatcgtgatgacacagtctccagacctccctggctgtgtctcgtgggcgagaacggccaccatcaactgcaagtccagccagtagttgtttanacagctaccgaanaataagaatactagctggacagcaagaaccaggaccaactctaaagctgctctagtttacgtgggctaacgttccgtaaccccggggaacgtccccgggggtccctagacccgtattcgaggtcggccgaggtccgggtctggggaactacggtaacttttccaacttccgacacccactcgacgcacgccctgaccgagggctagggaagtgtggtacggtacttaacgtttacgtttacgtcgtactaaccttagttttactaccttaatttaccttccctttacgtaccggtttcgggaaccggtaaacggttaaaccgtaagggttacggaaacgtacccttaagttaccgaacgtggtacggtcttacgaccttacctaagttccttg

SEQ ID NO: 364031 - DNA, 590 bp, Homo sapiens
  misc_feature: GZ8MTXP01CPPXE.17.6.A06.1.454.CMB.2.raw
  modified_base (228)..(228): a, c, t, g, unknown or other
  modified_base (311)..(311): a, c, t, g, unknown or other
  modified_base (377)..(377): a, c, t, g, unknown or other
  modified_base (386)..(386): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagacctccctggctgtgtctctgggcgagaaggccaccatcaactgacaagtccagccagagtgttttanacagctaccgaacaaataagaactacttagctaggtaccagacaagaaaccaggaccaacctcctaagctgctctatttacgngggcaacgttccgtaacccgggaacgtcccggggtcctgaccgtacttcgagtggcaggcgggtcngggacagtntttcactctcacatcagcagcctgcaggctaggagtcgtaggtcgtacttacgtttagttacgtcgttacctacttagttttatctatttaccttcctttacgtacgtttccgggaacggtacggaaaccgtagggttacggaaacgtcgttaaacgttaccgacgttaacggtggtcctaggtaccaccctaacgttcttccg

SEQ ID NO: 364032 - DNA, 600 bp, Homo sapiens
  misc_feature: GZ8MTXP01EVTOW.17.6.A06.1.454.CMB.2.raw
  modified_base (226)..(226): a, c, t, g, unknown or other
  modified_base (585)..(585): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgttttanacagctaccgaacaaataaagaaatacttagctggtacagcaagaaaccaggaccaacctctaaagctgctctatttacgtgggctacgtaccgtacccgggaatcccgggggtccctaggaccgtacttcgaggtggcgaggtcgggtctggggactagtacttcactctcacccatcagcacgcctgaccgaggctaggagtatggtacgtaccttacgttttattacgtcgttaccacctttagttttactacttattttacttcccttttacgtaccgtttcgggaacggtaaacggttaaccgtaagggttcgaacgtaaccttaacgttacgttaacgtggtcgtaacggtcncaaccttcgttcgtc

SEQ ID NO: 364033 - DNA, 580 bp, Homo sapiens
  misc_feature: GZ8MTXP01DVXXZ.17.6.A06.1.454.CMB.2.raw
  modified_base (232)..(232): a, c, t, g, unknown or other
  modified_base (319)..(319): a, c, t, g, unknown or other
  modified_base (353)..(353): a, c, t, g, unknown or other
  modified_base (379)..(379): a, c, t, g, unknown or other
  modified_base (385)..(385): a, c, t, g, unknown or other
  modified_base (401)..(401): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgccgtacggggacatcgtgatgacacagtctccagactccctggctgtgtctcgtgggcgagaacggccaccatcaactgacaagtccagccagtagttgttttanacagcctaccgaaacaaataaagaaattacttaagcttggaccagcaaagaaaccagaccaacctactaaagctgctactatttacngggctacgttccgtacccgggatcccggggtccngaccgtattcgagtgcaggtcgggtntgggangtacttcactctcacntcagcacgcctgacgacgcgtgaggtagtggtcggaccttacgtttacttacgttcgttacctaccttagtttactacttattacttcctttactcgtttcggaacggtaacggttaacgaagggttagacgtaccttagttaccgagtgtaggcttcgaccttactaacgttcgttcg

SEQ ID NO: 364034 - DNA, 588 bp, Homo sapiens
  misc_feature: GZ8MTXP01ASERE.17.6.A06.1.454.CMB.2.raw
  modified_base (232)..(232): a, c, t, g, unknown or other
  modified_base (314)..(314): a, c, t, g, unknown or other
  modified_base (381)..(381): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagaatccctggctgtgtctcgtgggcgagaacggccaccatcaactgacaacgtccagccagagttgttttaanacagctaccgaacaaataagaaatactagctggaccagacaagaaaccaggaaccaacctacctaagctgctctatttacgngggactagtaccggtaccgggacgtcccgggggtcctcggaccgtacttcgagtggcaggccgggtntggactagtacttcactcacacccatcagcacgcctgacgtaggctggacgtagtggcgtactacgtttattacgttcgtaccttacgttaatttctacttactttcttccctttactacggtttacgggaacggtaacggttaaccgtagggttcggaacgtacttaacgttacgacgtggtacggctgaccttactcttcgttcg

SEQ ID NO: 364035 - DNA, 790 bp, Homo sapiens
  misc_feature: GZ8MTXP01EIYNY.17.6.A06.1.454.CMB.2.raw
  modified_base (182)..(182): a, c, t, g, unknown or other
  modified_base (232)..(232): a, c, t, g, unknown or other
  modified_base (245)..(245): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgccgtacggggacatcgtgatgacacagtctccagacctccctggctgtgtctcgngggcgagaacggccaccatcaactgacaagtccagccagtagttgtttanacagctaccgaanaaataaagaatactagctaggaaccagacaaagaaaccaggaaccaacctctaaagctacgctactaactttacgcgggactacgtacccggtaacccggggaacgttccccgggggtaccctacggacccgtattccggaaggtcgggaccgacgggtcccggggtacttaacgggggaactaaacggtactttacccgacccttacctaccaaaccctagtaccgaacggccaaccggtccccttggaacccggtagggtaccgtagggaacgggtagttcggggtacgtaccctttaaacgtttttaacgttaccggttaccgttaaccctaaccgttttaagtttttaaccacctttaaacgtttttaccttaccccgtttttacgtaaccggggttttccggggaaaccggggttaaacggttaaaacccggtaagggggttaaccggaaacgttaaaccccgaaagtttaccccggaaaggtttcggggtaccgttccgtaacccggtaccttaacccggttaactttccgggtttccc

SEQ ID NO: 364036 - DNA, 677 bp, Homo sapiens
  misc_feature: GZ8MTXP01AY207.17.6.A06.1.454.CMB.2.raw
  modified_base (230)..(230): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgccgtacggggacatcgtgatgacacagtctccagacctcctggctgtgtctcgtgggcgagaacgccacatcaactgacaagtccagccagtagttgtttaanacagctaccgaactaaataaacgaacttacgtagtcgtacggtaaccagacaaacggaaaacccgacggaaccctaaacccgttaccgtaaagcctacgtacttacgttaacgtttacggcgggtactacgttacccggtaacccgggggtacgttccccgggtcctagaccgtatcgaggtggcgaggtcgggtacgtgggactacgtacttaccacgtctacactactcgacgacacgccgtgacgagggtctaggacggtagtggtcgtacttacgtttacgtacgttcgtacctaacgtttgtttactacttaacgtttaccttcccgtttacgtaccggtttcgggaacgggtaaacggttaaaccgtaagggttcgtaaaccgtaacgttacgttaccgttaggtaacgcggtaacacgaccttacgtcgttcgttaaccg

SEQ ID NO: 364037 - DNA, 524 bp, Homo sapiens
  misc_feature: GZ8MTXP02G2GFL.17.6.A06.1.454.CMB.2.raw
  modified_base (225)..(225): a, c, t, g, unknown or other
  modified_base (429)..(429): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttanacagctccgacaataagaaatactagcttggtaccagcagaaaccaggacaacctcctaagctgctcatttactgggcatctaccgggaatcccggggtccctgaccgattcagtggcagcgggtctggggacagatttcactctcaccatcagcagcctgcaggctgagatgtggctactttattactgtcacctagttttanctattactcctttcactttcggacggtaaggaaaccgtaaagggtggaacgtacccaagtaaccgaaactggtggccttggaccacctatcttcg

SEQ ID NO: 364038 - DNA, 533 bp, Homo sapiens
  misc_feature: GZ8MTXP02FT95P.17.6.A06.1.454.CMB.2.raw
  modified_base (225)..(225): a, c, t, g, unknown or other
  modified_base (236)..(236): a, c, t, g, unknown or other
  modified_base (425)..(425): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttanacagctccganaataagaatactagctgaccagcagaaaccaggacaacctcctaaagctgctcatttactgggcatctacccgggatccggggtcctgaccgattcagtggcagcggtctgggacagtattcactctcaccatcagcagcctgcaggctggagatgtaggctaactttattactgtaccaactatttanctatttatcctttacgtactttcggacggtaggaaaccgtaagggtagaacgaacctaagtaaccggtaaactggtacggcttacggcctaacccgtattcgtttccg

SEQ ID NO: 364039 - DNA, 528 bp, Homo sapiens
  misc_feature: GZ8MTXP02FTAS6.17.6.A06.1.454.CMB.2.raw
  modified_base (225)..(225): a, c, t, g, unknown or other
  modified_base (236)..(236): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttanacagctccganaataagaaatacttagcttggtaccagcaagaaaccaggacaacctcctaagctgctcatttactgggcatccgtacccgggaatcccggggtcctgaccgattcagtggcaggcgggtctggggacagatttcactctcgggaccactcagcagcctgcaggctgaggatgtggctactttattactgtactactagtttatctatttactcctttctacgtttcggacggtacggaaccgaaggtaggacgtaccaactacgaactaagtcggtctacgcaccactctcg

SEQ ID NO: 364040 - DNA, 533 bp, Homo sapiens
  misc_feature: GZ8MTXP02GQ5M1.17.6.A06.1.454.CMB.2.raw
  modified_base (225)..(225): a, c, t, g, unknown or other
  modified_base (298)..(298): a, c, t, g, unknown or other
  modified_base (347)..(347): a, c, t, g, unknown or other
  modified_base (355)..(355): a, c, t, g, unknown or other
  modified_base (424)..(424): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctagctgtgtctctgggcgagaaggccaccatcaactgcaagtccagccagagtgtttanacagctcgacaataagaaatactagcttggtaccagcagaaaccaggacaacctcctaagctgctcatttacngggcatctacccgggaatccggggtcctgaccgattcagtgcagcggtntggggacngatttcactctcaccatcagcagcctgcaggctgaggatgtggctactttatactgtcacctagtttanctatttactcctttactacgttttcggcggtaacgggtaaacctaaacgggtagggacgtacccgaacgttaccgaaacgttgtcggacttacgaccactactcgttcg

SEQ ID NO: 364041 - DNA, 569 bp, Homo sapiens
  misc_feature: GZ8MTXP02FUW0S.17.6.A06.1.454.CMB.2.raw
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttatacagctccgacaataagaatactagctggtaccagcagaaaccaggacaacctcctaagctgctcatttactgggcatctacccgggaatcccggggtcctgaccgattcagtgcagcggtctggggacagatttcactctcaccatcagcagcctgcagctgagatgtggctactttagttactgtactacctagtttatactatttacttccctttactacgtttccgggtacggtaacggaaaccgtaaaggggttacgggaacgtaacccgtaaacgtaaccggtaaaccgtaagggttacggaccgttacggaccctaacccgtaacttccgtttacgg

SEQ ID NO: 364042 - DNA, 635 bp, Homo sapiens
  misc_feature: GZ8MTXP02IZ5D6.17.6.A06.1.454.CMB.2.raw
  modified_base (226)..(226): a, c, t, g, unknown or other
  modified_base (311)..(311): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagttgtttanacagctaccgaacaataagaactactagcttaggtaccagacaagaaaccaggaccaacctacctaagctcgctactatttacgngggctaactccgtaaccccggggaacgtccccggggtccctaggaccgtacttcgagtcggaccaggccgggttcgtggggaacctaggtactttaccacttcctaccaccctatcagcacgcctgacgacggctaggaggagtggtcggtacttaactttattacttcgtacctaaccttagttttactactaactttacttcctttactaccgtttcgggacggtaacggtaaacccgtaagggtacggaaacgtaacccgtaacgtaaccggtaaacgttgggtacggaccgtacggaccctacccgtagttacctttccg

SEQ ID NO: 364043 - DNA, 573 bp, Homo sapiens
  misc_feature: GZ8MTXP02HOBJ7.17.6.A06.1.454.CMB.2.raw
  modified_base (227)..(227): a, c, t, g, unknown or other
  modified_base (301)..(301): a, c, t, g, unknown or other
  modified_base (449)..(449): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccggagagtgtttanacagctaccgaacaataagaaatactagcttaggaccagacagaaaccagacaacctctaagctgctcattacnggcatccgtaccggaacgtccggggtccctgaccgtacttcgaggtcgacgaggtccgggtctcgggggactagtactttccgacttcctacaccctatacagcacgccctgcgaggctaggagatggtacggacttactttattacngttacctaacttagtttacacttattacttccctttactacgttcggacggacggtaaaccgaggtacggaactacctaacgtaaccgtaagtgtacggtctacgactacccagttcctttacg

SEQ ID NO: 364044 - DNA, 540 bp, Homo sapiens
  misc_feature: GZ8MTXP02F84SL.17.6.A06.1.454.CMB.2.raw
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagtgtttatacagctccgacaataagaactactagcttggtaccagcaagaaaccaggacaacctccaagctgctcatttactgggcatccgtacccgggactccggggtcctgaccgattcagtgcagcgggtctggggacagtattcactctcaccatcagcacgctgacaggctgagatgtgctactttatactgtactactagtttatactattactcctttactacgtttcggacggtaacggtaaaccgaagggtacggaacgacctaacgtaccgtaaacgtggtacggacgttacgacctaccgtacttcgttacg

SEQ ID NO: 364045 - DNA, 516 bp, Homo sapiens
  misc_feature: GZ8MTXP02IMLE6.17.6.A06.1.454.CMB.2.raw
  modified_base (225)..(225): a, c, t, g, unknown or other
  modified_base (286)..(286): a, c, t, g, unknown or other
  modified_base (418)..(418): a, c, t, g, unknown or other
  modified_base (449)..(449): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagatgttttanacagctccgacaataagaatactagcttgtaccagcagaacagacaacctcaagctgctanatttactggccatctacccgggaaagtccggggtccctgaccgattccgagtcggacaggccggtctgggggacaggtaactttccactcgtacaccctatccaagcagaccctgaccaggctagagtatgngctactttattactgtacaacctgtttaacnctattatcctttcacgtttcgacggagtaaccaggtagacgacactacgactgtgctgctacatctg

SEQ ID NO: 364046 - DNA, 613 bp, Homo sapiens
  misc_feature: GZ8MTXP02IR308.17.6.A06.1.454.CMB.2.raw
  modified_base (228)..(228): a, c, t, g, unknown or other
  modified_base (315)..(315): a, c, t, g, unknown or other
  modified_base (381)..(381): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctcgtgggcgagaaggccaccatcaactgcaagtccagccagagttgttttanacagctccgaacaaataaagaaattacttagcttaggtaccagcaagaaaccaggaaccaacctcctaagctgcctactatttacgnggcctactaccgtaacccgggaactcccggggtccctaggaccgtattcgagtggcaggccgggtntggggacagtacttccactcacaccatcacgcacgccgtgacgacggcgtacggaggtagtggttacggtacttacttttacgttacgttcgttacctaccgttacgttttactactttactttacttccttttacgtacgtttccggaacggtacggaaaccgtaggtaacggacgtaaccgtagtaaccgtaacgttggtcggtactacgtactacctacgttcgtttcg

SEQ ID NO: 364047 - DNA, 571 bp, Homo sapiens
  misc_feature: GZ8MTXP02I85WV.17.6.A06.1.454.CMB.2.raw
  modified_base (227)..(227): a, c, t, g, unknown or other
  modified_base (305)..(305): a, c, t, g, unknown or other
  modified_base (381)..(381): a, c, t, g, unknown or other
  modified_base (389)..(389): a, c, t, g, unknown or other
  modified_base (455)..(455): a, c, t, g, unknown or other
tcagcgtagactagcacgaccggtgctcgatttagatctactgacaggggacaacaggcaggcaggggcagcaagatggtgttgcagacccaggtcttcatttctctgttgctctggatctctggtgcctacggggacatcgtgatgacacagtctccagactccctggctgtgtctctgggcgagaaggccaccatcaactgcaagtccagccagagttgttttanacagctccgacaataagaaatacttagcttggtaccagcaagaaacccaggaccaacctcctaagctgctcatttacngggacactccgtacccggggaacgtcccggggtccctggaccgattccgagtggcaggccgggtctggggacagtnttcactcncaccatcagcagcctgcacggctggaggatggtgcttatttattacgtcgtctacctagttttacncttattacttcctttacgtacgtttccgggacggtaacggaaaccgtaagggtacggaacgtaccgtaacgtaaccggtaactgggtcgactacggctaaccgtacttcgtttacg

SEQ ID NO: 364048 - DNA, 556 bp, Homo sapiens
  misc_feature: GZ8MTXP01DVRG1.10.30.C08.1.454.CMB.2.raw
  modified_base (304)..(304): a, c, t, g, unknown or other
  modified_base (372)..(372): a, c, t, g, unknown or other
  modified_base (460)..(460): a, c, t, g, unknown or other
  modified_base (472)..(472): a, c, t, g, unknown or other
  modified_base (500)..(500): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtcctgagactctcctgtacagtctctggattcacctctgatgattatgccatgcactggggtccggnaaggctccgagggggaagggcctgggagtggggtctctggaatcattacaatagtgatttcctaaatntgcggactctgtgagggggtctttcaccatctccagacgacaacgaccaggaactccctctactctaacaaatggaaacagtctaganacctgaggaacncggtccttatatttctgtgcaaaagttntcgtggacgcgttcggccgtgaaccgtcggtcggggaccgtaacgggaacccgtgg

SEQ ID NO: 364049 - DNA, 685 bp, Homo sapiens
  misc_feature: GZ8MTXP01BYCI8.10.30.C08.1.454.CMB.2.raw
  modified_base (303)..(303): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccgnaagctaccgagggggaagggcctgggagtgggtctcgtaggaatcacttaacaaattagtgtaattttacccttaaaataattggcggaacttcgtggttgggacggggggtcttttacaccctatctacccagacgaacaacgccaaggtaacctcccctactaactcttaaaccaaattacggggaaactacggttaccttaggaacgaccccgtggaacggaacctaccgggtacccttttaagttaatttttccgtaagggttaaacgaaacgtaaaaagttacgttcggtttacgggacgttccggttaccgggcccggttacgaacccggtacggggtacgggggacccggtaaccgggggttaaccccgttgggg

SEQ ID NO: 364050 - DNA, 576 bp, Homo sapiens
  misc_feature: GZ8MTXP01CQA5J.10.30.C08.1.454.CMB.2.raw
  modified_base (499)..(499): a, c, t, g, unknown or other
tcagcatagtagtgcacgaccggtgctcgatttagtctgacgtcaaagggaaaggggtgggagaggagacccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccgcaagctccgaggggaagggcctgggagtgggtctctggaatcactttacaaatagtgatttacctaaataattgcggatctgtggaggggctttcaccatctacagagacaacgccaggaacctccctatatctaacaaatggaacagtctagagacctgagacacggtccttatatttcaaggttagttaaaagtnttcgttagggagcgttcgggcccgttaagacccgtaacgttcgggggacccttacgggggaaccccttggggtcccg

SEQ ID NO: 364051 - DNA, 620 bp, Homo sapiens
  misc_feature: GZ8MTXP01EJ7RG.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcacgtcgggtccggacaagctccgagggggaacggctgggaggtgggtctcgtggaactcaacttacaactagtgtatttacctaaatatgcggtactcgtgtgggaggggtcgtttacaccgtatctaccagacgacaacgaccaaggaacctccctacatctaacaaagtcggaaactagtctagaacgacctggacggaacgtaccggtacctttaagttactttcgtgtaacggttaacaaaagttcgttacgttgggacgttcgttagggccccgtagaacccgcgggtcgggggacctaaccggggttaaccccgttcgggg

SEQ ID NO: 364052 - DNA, 560 bp, Homo sapiens
  misc_feature: GZ8MTXP01D7N5S.10.30.C08.1.454.CMB.2.raw
  modified_base (440)..(440): a, c, t, g, unknown or other
  modified_base (477)..(477): a, c, t, g, unknown or other
  modified_base (491)..(491): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcactgggtccgcaagctccgaggggaaggcctgggagtgggtctcgtggaatcacttacaatagtagatttacctaaataatgcggactctggtgagggggtctttcgaccatctccagagacaacgccaggaactcctctatctaanaatggaacagtctagagacctgagacacgtccttatnttctgtgacaaagntcgttggagcgttacgggccgtagaacccgtacggtcggggacccgtaacggggttaacccgttcgggg

SEQ ID NO: 364053 - DNA, 677 bp, Homo sapiens
  misc_feature: GZ8MTXP01C1R3A.10.30.C08.1.454.CMB.2.raw
  modified_base (504)..(504): a, c, t, g, unknown or other
  modified_base (512)..(512): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtatttttcctctttgcttaattttaaaaggtgtcctctgtgaagaacttattagtggaatcgtggggagccttggtacagccgtggcgggtccctgagactctctgtacagtctctggattcacctctgatgattatcgccatgacacgtgggtcccggacaacggccgtaccgagggggaacgggccgtgggacggttcggggttactcgtaggaacttacgacttaactaattagtagttatttaccttaaatacgtcgcgtacttagtgggtagggagggggttccttacgacctagttccacgacgaagaccaaccgaccaacggtacctaccctataactactaanaaacgtanaactacgtactagggaactacgtaggacgtaaaccgtcgtaccttaattactttcgtaaggttccgaaagttaaaagccgtttagtgggaaccgttcggttaccgggcgtacggtaacccacggggtacgggttaccggtaaaccggggttaacccgtttcgggg

SEQ ID NO: 364054 - DNA, 607 bp, Homo sapiens
  misc_feature: GZ8MTXP01AO50L.10.30.C08.1.454.CMB.2.raw
  modified_base (218)..(218): a, c, t, g, unknown or other
  modified_base (517)..(517): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggganccttggtacagcctggcgggtccctgagactctcctgtacagtctctggattcacctctgatgattatgccatgcacgtgggtccgcaagctaccgagggggacggcctgggagtggggtctcgtggaatcacttacaatagtgatttacctaaatatgcgactcgtgtgggagggggtctttcaccatctccagacgaccaacgaccgaggaacctccctactactaccaactaaatacgggaaactagtcctagaacgcctaggagaaccgacggtaccttattacttctgtacganaaaagttcgtacgttgggacgttcgttacgggcccggtggtaacccgacgggtcgggggacccgtaacgggggttaacccgttccggggg

SEQ ID NO: 364055 - DNA, 635 bp, Homo sapiens
  misc_feature: GZ8MTXP01CIYF7.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcacgtgggtccggcaagcctccgagggggaacggccgtgggaggtggggtctcgtggaactcacttacaatagtgtatttaccttaaataatcgcggactcgtggtggagggggtctttcacctatctccagacgaacaaccgccaacggaacctccctactactactaacaaacttacggaactaaggtctaggacgacccgtggacggaccacgggtcctttaattaactttcgtaagttacgaacgtaaaagttacgttacgttagggacgttcggttacgggcccggttcgaaccgtacgggtcgggggacccgtaaccgggggttaacccgttcgggg

SEQ ID NO: 364056 - DNA, 644 bp, Homo sapiens
  misc_feature: GZ8MTXP01CU0T6.10.30.C08.1.454.CMB.2.raw
  modified_base (219)..(219): a, c, t, g, unknown or other
  modified_base (308)..(308): a, c, t, g, unknown or other
  modified_base (559)..(559): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctatttttaaaaggtgtcctctgtgaagaactattagtggaatcgtggggganccttggtacagcctgggcggtccctgagactctcctgtacagtctctggattcacctctgatgattatgccatgcacgtgggtcccganaagctccgaggggaaggcctggagtgggtctcgtggaatcaacttacaattaggtagtatttacctaaaatatgcggtactcgtggtcgggagggggtccttttcgacctagtcctaccgagacgaacgaaccgaccgaacggaaccttccctactactactaaacaaagtacggaaactagttctacgaacgtaccgtcgaaggaacctacggtaccctttatactttcgtgttacgaactaaaaggttnttaccgttggaacggttcgttacgggtcccggtacgaacccgtacgggtcgggggacccgtaacggggttaaccccgtttcgggg

SEQ ID NO: 364057 - DNA, 642 bp, Homo sapiens
  misc_feature: GZ8MTXP01CY5AE.10.30.C08.1.454.CMB.2.raw
  modified_base (363)..(363): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaacttattagtggaatcgtggggggagccttggtacagcctggcgggtccctgagactctcctgtacagtctctggattcacctctgatgattatgccatgcacgtgggtccgacaagctccgaggggacggcctgggagtgggtctcgtggaatcacttacaatagtntatttactaaatatgcgactcgtggtggagggggtcttacgactatctaccgagacgacaacgaccgacgaacctccctactactactaaactaaagtacgaacgtacgtacgtacggaacgacctaggacggtaaccgtacggtacctttagtacttttacgtggttaacgaaacgtaaaaagttcgtttaccggtaggacgttcgttccgggtccgttaccggaacccgtaccgggttacggggacccggtaaccggggttaaccccgtttccgggg

SEQ ID NO: 364058 - DNA, 629 bp, Homo sapiens
  misc_feature: GZ8MTXP01EMG5W.10.30.C08.1.454.CMB.2.raw
  modified_base (308)..(308): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtgggggagccttggtacagccgtggccgggtccctgagactctcctgtacagtctctggattcacctctgatgattatgccatgcacgtggtccganaagctcgagggaggcgtggagtgggtctgaggtaatcgtacttacaacgtagtagtatttacctaaatatcgcggtactcgtggtagggacgggggtctttacgacctatctacaggacaaccgaacgcccgaacggtaacctccctactactactaacaaactaggaaactagtctagacgtaccgtagacggaaccacggtaccttaattactttgtaacgttagaaacgtaaaggttacttacggttggacgttcgttacgggtccgtcgaacccgtacgggtacggggaccgtaacggggttaaccccgtttcgggg

SEQ ID NO: 364059 - DNA, 570 bp, Homo sapiens
  misc_feature: GZ8MTXP01B5RVZ.10.30.C08.1.454.CMB.2.raw
  modified_base (446)..(446): a, c, t, g, unknown or other
  modified_base (484)..(484): a, c, t, g, unknown or other
  modified_base (499)..(499): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcacgtgggtccggacaagccgtccgagggggaacgggcctgggagtgggtctcgtggaatcacttacaatagtgtatttacctaaatagtgcgatcgtggtgagggggtctttcaccgatctcagacgacaacgccgagactcctctatctaanaaatcgaactgtctgagacctgacgacacggtcttatnttctgtgacaaaagngtagttggagttcgttcgggtccgtacgaaccgacggtcggggacccgtaacggggttaacccgttcgggg

SEQ ID NO: 364060 - DNA, 633 bp, Homo sapiens
  misc_feature: GZ8MTXP01A0ITO.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggagccttggtacagcctgggcgggtccctgagactctcctgtacagtctctggattcacctctgatgattatgccatgctacgtggggtccgcaagctccgaggggaacggcctgggacgtgggtctcgtggaatcaacttacaatacgtgtactttaccttaaatattcggcgtactcgtggtgggtacgggggtctttacactatctacgagacgacaacgccgaagtacctccctatactactaacaaatcgaaactggtactaggacgaccgtggaacggtaccctacggtaccctttaatttacgtttcgtaaggttacgaactaaaaacgggttgttacgttagggcgttcggttaccggtccgtacggaacccgacggggtccggggacccgtaacggggttcccggttcgg

SEQ ID NO: 364061 - DNA, 582 bp, Homo sapiens
  misc_feature: GZ8MTXP01DEVB4.10.30.C08.1.454.CMB.2.raw
  modified_base (411)..(411): a, c, t, g, unknown or other
  modified_base (439)..(439): a, c, t, g, unknown or other
  modified_base (453)..(453): a, c, t, g, unknown or other
  modified_base (473)..(473): a, c, t, g, unknown or other
tcagcatagtagtgcacgaccggtgctcgatttagtctgacgtcaaagggaaaggggtgggagaggagacccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcactctgatgattatgccatgcacgtgggtccggcaagctccgagggggaacggccgtgggaggtgggtctcgtaggaatcacttacaactagtagtatttacctaaatatgcgactcgtggtggaggggtcttcaccatcnccagacacaacgccagactccctatacnctaacaaatgaacngtctagagacctgaggaacncggtccttatacttcgtaagtaacgttaaagtattcgttagggaacgttcgttcgggcccgtggaccctaaggtcgggggacccgacggggtaacccttcgggttcccg

SEQ ID NO: 364062 - DNA, 604 bp, Homo sapiens
  misc_feature: GZ8MTXP01CTUFT.10.30.C08.1.454.CMB.2.raw
  modified_base (219)..(219): a, c, t, g, unknown or other
  modified_base (308)..(308): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtggggganccttggtacagcctgggcgggtccctgagactctcctgtacagtctctggacttcacctctgatgattatgccatgcacgtgggtccgnaagctcgaggggaggccgtgggagtgggtctcgtggaatcacttacaattagtgtatttacctaaatagtgcggtactcgtggtgggaggggtctttcacctatctaccagacgaccaacgccacggtaacctccctactactactaacaaagtcgaaactacgtactacggaacgacccgtggaacggtaccgacggtacctttatactttcgaagttagaactaaagcttacgttggacgttcgttcggccggtcgaaccgcggtcggggacccgtaacgggaacccgttcggg

SEQ ID NO: 364063 - DNA, 716 bp, Homo sapiens
  misc_feature: GZ8MTXP01BRPKL.10.30.C08.1.454.CMB.2.raw
  modified_base (275)..(275): a, c, t, g, unknown or other
  modified_base (285)..(285): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggagccttggtacagcctggcgggtccctgagactctcctgtacagtctctggattcacctntgatgattangccatgctacgtcggggtccgacaaagcctaccgagggggaacgggcctaggggtaggttcgggtcttcgtaggaaacttcgtaacttaacgtaagtaggttagtaacttttaccttaaaataagtcggcgggtacttcgttgggtaggggtacgggggttctttacaaccgtacttaccgtaccgagaacgaaccgaacggacccgaacggtaaaccttcccctataactactaaacaaacttacgggaaactacgttacctaggaacgtacccgtagggtaacggaaccgtaaccgggttacctttaattacgttttccgaaggttacggaaacctaaaacgttagttccggtagggttaacgttcgttaccgggccgttcggaacccgtacgggcggggttacccgaaccgggttaacccgttccggg

SEQ ID NO: 364064 - DNA, 645 bp, Homo sapiens
  misc_feature: GZ8MTXP01BSNXR.10.30.C08.1.454.CMB.2.raw
  modified_base (309)..(309): a, c, t, g, unknown or other
  modified_base (383)..(383): a, c, t, g, unknown or other
  modified_base (483)..(483): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtgggggagccttggtacagccgtgggcgggtccctgacgactctcctgtacagtctctggattcacctctgatgattatgccatgcacgtgggtccgnaacgctcgaggggaggctgggagtgggtctcgtaggaactcgtacttacaataggttgtactttaccttaaatntcgcggtactcgtggtcgggacggggtcgtttacacctatctccgaagacgaacaacgcccaacggtacctcccctaactaccctaacaaagctaaacgngttaccgagacgaccgtaggacggtaacacgggttcccttaagttactttccgtggtaacggtaacaaaaggtccttgttaacggggtcttccgttggggcccgttaacggacccgaagggttccggggaccgttacggggtaaccccgttggggttccccg

SEQ ID NO: 364065 - DNA, 600 bp, Homo sapiens
  misc_feature: GZ8MTXP01BZM5B.10.30.C08.1.454.CMB.2.raw
  modified_base (286)..(286): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattangccatgcacgtgggtccgcaagctccgagggaggcctggagtgggtctcgtggatcattacaatagtgtatttccttaaatatgcggactcgtggtggagggggtctttcgaccatctaccagagacaacgaccaggacctccctctactactaacaaatcgggaaactagtacctagacgacccgtaggacggaaccgtaccggtccttattacgtttctgtgacaaaaggttcgtacgttagggacgttcgttcgggtcccgtcgaacccgtcgggtcggggaccggtaaccggggttaaccccgttcgggg

SEQ ID NO: 364066 - DNA, 709 bp, Homo sapiens
  misc_feature: GZ8MTXP01BXVRD.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtgggggagccttggtacagccgtgggcgggtccctgagactctcctgtactagtctctggacttcacctctgatgattatgccatgcacgtgggtccgcaagcctacgagggggaacggccgtgggtaggtcgggtctcgtaggtaatcacttaacaattagtgtatttacctaataatgcggtatcgtggtggtacgggggtcttcactatctccgagtacgaaccacgacccgaacggtaacctcccgtactaactacctaaactaaacgtacggtaaacgaggttaccgagtaaacgaccccgttggaaacgggtaccccgtaacggggttacccctttaagtttacgttttccgtaagggtacgttaaaccgtaaaaaaggttcgtttacccgggttggttaacgggttcgttaccgggggtcccggttcgggaaacccgttcccggggacggggggaaccccgtaaccgggggttaacccccgtttccggggg

SEQ ID NO: 364067 - DNA, 627 bp, Homo sapiens
  misc_feature: GZ8MTXP01DTMVQ.10.30.C08.1.454.CMB.2.raw
  modified_base (309)..(309): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtattttcctctttgcttaattttaaaaggtgtcctctgtgaagaactattagtggaatcgtgggggagccttggtacagcctggcgggtccctgagactctcctgtacagtctctggattcacctctgatgattatgccatcgcacgtgggtccgnaagctccgaggggaggcctgggagtgggtctcgtggaactcacttacaattagtgtaattttacctaaatatgcggtactcgtggtcggtagggggtcctttcgacctattcctacgagacgacgaacgaccaacggtacctccctactactactaacaaagtacggaactagtactagacgtaccgtaggaacgaccgtacggtacctttaattactttcgtaagtagttaacgaaaagttgttacgttggacggttcgttcgggccgttacgaacccgtacgggtcggggaccgtaacggggttaacccgttcggg

SEQ ID NO: 364068 - DNA, 679 bp, Homo sapiens
  misc_feature: GZ8MTXP01AYUWE.10.30.C08.1.454.CMB.2.raw
  modified_base (219)..(219): a, c, t, g, unknown or other
  modified_base (280)..(280): a, c, t, g, unknown or other
  modified_base (310)..(310): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtggggganccgttggtacagcctgggcgggtccctgagactctcctgtacagtctctggacttcacctntgatgattatgccatgcacgtgggtccganagctcgaggggacggcgtggagtgggtctcgaggtaactctaacttaacaagttagtagtaacttttaccttaaaatactacggcggtacgttcgtagggtcgggacgggggtctttcaacccgtatctacccgaagacgaccgaacgaccccgaacggaaacccttcccgtactaactactaaacaaatcggaaactagtcgtacgaacgtaccgtaggaacgggtactaccgggtacctttaattacttcgttaagtaacgaaagtaaaacgttcgttaaaccgttgggaacgttccggttcggggaaccccgtgtaacccgtacggggtaccgggggacccgtaacggggttaacccgtttcgggg

SEQ ID NO: 364069 - DNA, 685 bp, Homo sapiens
  misc_feature: GZ8MTXP01EXD4E.10.30.C08.1.454.CMB.2.raw
  modified_base (186)..(186): a, c, t, g, unknown or other
  modified_base (218)..(218): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctntgtgaagaactattagtggaatcgtggggganccttggtacagccgtgggccgggtccctgagacttctcctgtacagtctctggattcactatctgatgattatgccatgcacgtgggtccgcaagcctaccgagggggaggccgtggaggtggtctcgtagatcagttacatagtgtactttacctaaaatactgacgtactcgtggtgggtacgggggtctttacacctatcctccgaagacgaaccaaaccggaccaacggtaaccctccctactaacttaacctaaacgaaactacgaaacgtacttacgtagaaccgtcccgttaggaacggtaaccgtaccggttacctttaagttacgttttcttaggttacgtaaacgttaaaaggtacgtttccggttaggggacttaccgggttcgggtacccggtaacgggttaaaccccgcgggttacccggggggaacccgttaacccgggggtttaaccccggg

SEQ ID NO: 364070 - DNA, 704 bp, Homo sapiens
  misc_feature: GZ8MTXP01DVLBV.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaacttattagtggaatcgtgggggagccttggtacagcctgggcgggtccctgagactctcctgtacagtctctggattcactctgatgattatcgccatgctacgtgggtccggacaagctccgaggggaacgggcctgggagtggggtctcgtaggtaactacaacttactaagttagttagtacttttaccttaaatatgcggtactcgtgggtcgggacgggggtctttcgacctatctccagacgacaacgaccacggtaacctccctacttactctaaactaaactacggtaaactagttacgtacgtaacgaccgtaggtacggaaccgtaaccgggttacctttaagttacgttttccgtaaggttacgttaaaccgtaaaaggttaacgttaccggtttagggttaacgttccgggttaacgggtcccgggttacggaaccccggttaccggggtaccgggggttacccggtaaccgggggttaaccccggttttcccgggg

SEQ ID NO: 364071 - DNA, 761 bp, Homo sapiens
  misc_feature: GZ8MTXP01AKSH0.10.30.C08.1.454.CMB.2.raw
  modified_base (220)..(220): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttaattttaaaaggtgtcctctgtgaagaactattagtggaatcgtggggganccttggtacagcctgggcggtcctgagactctcctgtacagtctctggtattcacctctgtatgattatgccatcgccacgtcgggtccgacaagtccgtaccggagggggaacgggtccgtaggggtacggttcgggttccttacggtaggtaaactctaaacgtttaacaaagttacggttagttaactttttaacccttaaaagttaacgtacgggtcgggttaaccgttcggttaggggtagggtaaccgggggggttccttttacgaaccccgtactttacccgtaccgaaacggaacggaaacccaaccgtacccggaaacgtaacctccccttactaactacctaaactaaatacggaaactagtacctaggaccgtaacccgtggaacggtaaccgtaaccggttaccttaaacttacgtttacctaaggttaacgaactaaaaaggttctacggttagggttacgcggttccggtaaccggtacgaacccggaacgggtccggggacccgtaaccgggttaaccgtcccggg

SEQ ID NO: 364072 - DNA, 592 bp, Homo sapiens
  misc_feature: GZ8MTXP01C0RVT.10.30.C08.1.454.CMB.2.raw
  modified_base (257)..(257): a, c, t, g, unknown or other
  modified_base (337)..(337): a, c, t, g, unknown or other
  modified_base (434)..(434): a, c, t, g, unknown or other
  modified_base (460)..(460): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctatttaaaggtgtcctctgtgaagactattagtggaatcgtgggggagccttggtacagcctgggcgggtccctgagactctcctgtacngtctctggattcactctgatgattatgccatgcactgggtccgcaagctccccgagggggaaggcctgggagtggggtcncgtggaaatcattacaattagtgatttcctaaataatgcggtactcgtgtgagggggctttcacccatctccagacgacaacgcaacggactccctntatctaacaaatggaacagtctgganacctggacgaccgacggtcctttattacgtttcgtgtaggacctaaaaagcgttacgtttgggaacgttcgttcgggaacccggtggtcccgacgtcgggggaccctaacgggggttaaccccgtttggggg

SEQ ID NO: 364073 - DNA, 558 bp, Homo sapiens
  misc_feature: GZ8MTXP02G3J3R.10.30.C08.1.454.CMB.2.raw
  modified_base (218)..(218): a, c, t, g, unknown or other
  modified_base (304)..(304): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctcttttgctattttaaaaggtgtcctctgtgaagaactattagtggaatctggggganccttggtacagcctggcgggtccctgagactctcctgtacagtctctggattcacctctgatgattatgccatgcactgggtccgnaagctccgaggggaaggcctgggagtgggtctctggaaatcaactttacaatagtgtatttcctaaaatatgcggtactctgtgagggggtctttcacccatctccagagacaacgcaggactccctctactctaacaaactagaacagtactagagaccgtacgaggacgacggaccttactattacttcgtgtacaaacgtaatacttacgtagcgtcgcgtcgacgacgtacggccgacgggaaccgtcgg

SEQ ID NO: 364074 - DNA, 565 bp, Homo sapiens
  misc_feature: GZ8MTXP02HXSB7.10.30.C08.1.454.CMB.2.raw
  modified_base (217)..(217): a, c, t, g, unknown or other
  modified_base (505)..(505): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtcctgagactctcctgtacagtctctggattcacctctgatgattatgccatgcatgggtccgcaagctccgaggggaaggcctggagtgggtctcgtggaaatcgacttacgaatagtgtatttaccttaaatatgcgtactctgtggacgggggtctttacaccatctccagagacaacgcaggactccctctatactaacaaatgaaactagtactagacgacctaggacgacgaacggtccttatattcgtgtagcaaaaagtntcgtaggacgtcgtcggtccgtagaccgtacggtcggggaccgaacggggtacccgtcgg

SEQ ID NO: 364075 - DNA, 538 bp, Homo sapiens
  misc_feature: GZ8MTXP02JDFA7.10.30.C08.1.454.CMB.2.raw
  modified_base (217)..(217): a, c, t, g, unknown or other
  modified_base (367)..(367): a, c, t, g, unknown or other
  modified_base (487)..(487): a, c, t, g, unknown or other
  modified_base (494)..(494): a, c, t, g, unknown or other
  modified_base (502)..(502): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacagtctctggattcacctctgatgattatgccatgcactgggtccggcaagctccgagggaaggcctggagtgggtctcgtggaatcacttacaatgtgatttcctaaatntgcggatctggtgagggggtctttcacatctccagagacacgccaggaactccctactatctaacaaatggaaaccagtacctagacgaccgtgaacggacacggtccttatattctgtnacaaaantactggancgtagccgtgaccacgtgggaccacgggaacctcgg

SEQ ID NO: 364076 - DNA, 664 bp, Homo sapiens
  misc_feature: GZ8MTXP02IKHJH.10.30.C08.1.454.CMB.2.raw
  modified_base (376)..(376): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcactctgatgattatgccatgcactggggtccgcaagcctccgaggggaaggcctgggagtggggtctcgtggaatcaactacaatagtgtattttacctaaaatntgcggtacttcgtggtgtacggggggtctttacgacctatcctaccgagacgaacaaccgaccgaacggtaacctccctactactactaaacaaattacgaaactagtcgtagaacgtcccgtaggtacggacctaacgggtacctttaattaacgtttcttaggttacggtaaactaaaaaggtacgttaccggttaggggtaacgtacgtacggggtcccgtacggtaaccccgtacggggtaccgggggacccgggaaccggggttaaacccccgggtttcgggg

SEQ ID NO: 364077 - DNA, 578 bp, Homo sapiens
  misc_feature: GZ8MTXP02HH1AY.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcactgggtccgcaagctccgaggggaaggcctgggagtgggtctcgtggaatcacttacaatagtgatttacctaaatatgcggactctggtgagggggtctttcacctatctccagacgacaacgccacggactccctactactctaaacaaatacgaactagtctagacgacctgaggacacggtaccttaatactttctgtacgactaaaacgtgtacgttaggacgtcgtgggccgtacggacctaccggtacggggacccgaacggggtaacccctcgggg

SEQ ID NO: 364078 - DNA, 551 bp, Homo sapiens
  misc_feature: GZ8MTXP02IL5B2.10.30.C08.1.454.CMB.2.raw
  modified_base (334)..(334): a, c, t, g, unknown or other
  modified_base (401)..(401): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgcactgggtccgcaagctccgagggaggcctggagtgggtctntggaatcattacaatagtgtatttccttaaatatgcggtactctggtgagggggtctttcaccatcnccagagacaacgcacggaactccctactactctaacaaatagaactagtctagacgacctgaggacacggccttaatattctgtgacaaagtatacgttggacgtcgtcggccgtgaccgacggtcggggaccgacgggaacccgtcggg

SEQ ID NO: 364079 - DNA, 623 bp, Homo sapiens
  misc_feature: GZ8MTXP02JTYCS.10.30.C08.1.454.CMB.2.raw
  modified_base (287)..(287): a, c, t, g, unknown or other
  modified_base (389)..(389): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggccgggtccctgagactctcctgtacagtctctggattcacctctgatgattangccatgcacgtggggtcccggcaagcctaccgaggggaaggccgtgggaggtgggtctcgtggaaatctaacttacaattagtagtactttaccttaaaatntgcggtactcgtggtgggagggggtctttacacctatcctccagacgaacgaaccgaccacggaacctccctactactacctaaacaaatagaacagtctagacgacctggacggacgaccggtacttatatttctagtagaaactaaaagtacttaggttacggacgtccgtggggtcccgtacggaacccgtacggtccgggggaccgtaaccggggtaaccccttcggggg

SEQ ID NO: 364080 - DNA, 581 bp, Homo sapiens
  misc_feature: GZ8MTXP02F17QR.10.30.C08.1.454.CMB.2.raw
  modified_base (217)..(217): a, c, t, g, unknown or other
  modified_base (362)..(362): a, c, t, g, unknown or other
  modified_base (510)..(510): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacagtctctggattcacctctgatgattatgccatgcacgtgggtccgacaagctccgaggggaacggcctggagtgggtctcgtggaaatcactttacaattagtntatttaccttaaaatatgcggactcgtggtgagggggtctttcacctatctccagagacaacgccaggaacctcctactatactaacaaatcgaaactagtctagacgacctggagacacggtccttatacttctgtagacaaaagtnttacgttaggacgtcgtagggccgtacgaccgtacggtccgggggacccaacggggtaaccccgttcgggg

SEQ ID NO: 364081 - DNA, 602 bp, Homo sapiens
  misc_feature: GZ8MTXP02HP9BN.10.30.C08.1.454.CMB.2.raw
  modified_base (218)..(218): a, c, t, g, unknown or other
  modified_base (306)..(306): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaacttattagtggaatctggggganccttggtacagcctggcgggtccctgagactctcctgtacagtctctggattcacctctgatgattatgccatgcacgtgggtccggnaagctccgaggggaacggcctggagtgggtctctggaatcacttacaatagtgtatttaccttaaatatgcggtatcgtggtagagggggtctttcaccatctccagagacaacgaccaggaactccctctatctaacaaatacgaaactagtctagaacgacctaggacggacgacggtacctttaatactttactacgtaggtaaacaaaaggtacttacgttacggagtcgttacggccggttacgaacccgtacggtcgggggtacccgaacgggggtaacccgttccgggg

SEQ ID NO: 364082 - DNA, 616 bp, Homo sapiens
  misc_feature: GZ8MTXP02GTQ7Y.10.30.C08.1.454.CMB.2.raw
  modified_base (217)..(217): a, c, t, g, unknown or other
  modified_base (258)..(258): a, c, t, g, unknown or other
  modified_base (387)..(387): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacngtctctggattcacctctgatgattatgccatgcacgtggggtccgcaaagcctaccgaggggaacggcctgggagtgggtctcgtaggaaatcgaacttacaattagtgtaacttttaccttaaaatntaggcgggtaacttcgtggtagggacggggggtctttcgaacctatcctaccgagaacgacaaacgccacggaacctccctactatactaaacaaatcgaaactagtctagacgacctagacggacacggtccttagtactttcgtagtagaacaaaagtatacgttaggacgtcgtacggccgtacgaccgtacggtacgggggaccgaaccggggtacccgttcggg

SEQ ID NO: 364083 - DNA, 702 bp, Homo sapiens
  misc_feature: GZ8MTXP02FWRO2.10.30.C08.1.454.CMB.2.raw
  modified_base (218)..(218): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggganccttggtacagcctggcgggtccctgagactctcctgtacagtctctggattcacctctgatgattatgccatgcacgtggccgcagctcgagggaggcctggagtgggtctcgtggaatcaacttacaaattagtagtaacttttaccttaaaatagttcggcgggtactcgtggtacgggaggggggttcctttaccacctattccgtacccaagaacgaaccgaaaccgacccgaacgggtaacccttcccctactaactaccttaaacaaaagttacgaaaaccagttacctaggaacgacccgttaggaaaccgggaaccgtaaccggggtccctttaaatttacgtttaccgttaggttacggtaaacctaaaaacggtagttaccgttaggggtaacgtccgttacggggaaccgtacggaaacccgtaccggggtacgggggaccccggaacgggggtaaaccccgtttccggggg

SEQ ID NO: 364084 - DNA, 610 bp, Homo sapiens
  misc_feature: GZ8MTXP02G818X.10.30.C08.1.454.CMB.2.raw
  modified_base (217)..(217): a, c, t, g, unknown or other
  modified_base (258)..(258): a, c, t, g, unknown or other
  modified_base (285)..(285): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacngtctctggattcacctctgatgattangccatgcacgtgggtccgcaagcctccgaggggaaggcctgggaggtgggtctcgtggaatcgaacttacaagtagtgtatttaccttaaatatgcggacttcgtggtggagggggtctttcacctatctccagagacacgcacgactccctctactctaaacaaatacgaactagtctagacgaccgtaggaacggacgacggtaccttaagttactttaccgtgtacgtaacgaaaagtacgtacgtttagggaacgtccgtggaacccgttcggaacccgtacggtaccggggacccgtaacggggtaaccccgtttcgggg

SEQ ID NO: 364085 - DNA, 581 bp, Homo sapiens
  misc_feature: GZ8MTXP02IIMU5.10.30.C08.1.454.CMB.2.raw
  modified_base (410)..(410): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcactctgatgattatgccatgcactgggtccggcaagctccgaggggaaggcctgggagtgggtctcgtggaatcattacaatagtgtatttacctaaatatgcgggtactcgtggtgaggggggtctttcgacctatcncagagacaacgcacggaactcctctatctaacaaatagaaactagtactagacgacccgtagacggacacgggtcctttagtatttcgtagttagacaaaagtacttacgttaggacgtcgtcggtccgtacgaccgacggtcggggaccgacgggtaacccgttccgggg

SEQ ID NO: 364086 - DNA, 637 bp, Homo sapiens
  misc_feature: GZ8MTXP02FYMWY.10.30.C08.1.454.CMB.2.raw
  modified_base (378)..(378): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgattatgccatgctacgtgggtccggcaagctccgaggggaacggcctgggagtgggtctcgtaggaatcacttacaatagtgtatttaccttaaatntgcggactcgtggtgagggggtctttcactatctccagacgaccaacgacccgagaacctccctactatctaaacaaagtagaaacagtacctaggaacgtacccgtaggacggacgtaacggtcctttaattactttctaggttacgaaaccgtaaaaggtacttacgttagggtaacgccgttacggggcccggttacggaaacccgaccggggttaccgggggacccggtaaccgggggtaacccctttccggggg

SEQ ID NO: 364087 - DNA, 529 bp, Homo sapiens
  misc_feature: GZ8MTXP02FOA1S.10.30.C08.1.454.CMB.2.raw
  modified_base (284)..(284): a, c, t, g, unknown or other
  modified_base (368)..(368): a, c, t, g, unknown or other
  modified_base (403)..(403): a, c, t, g, unknown or other
  modified_base (480)..(480): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtcctgagactctcctgtacagtctctggattcacctctgatgattangccatgcactgggtccggcaagctccagggaaggcctgggagtggggtctctggaatcacttacaatagtgatttcctaaaatntgcgactctgtgagggggctttcacatctccaganacaacgccaggaactccctctactctacaaatgaacagtctgagacctgagacacggcctatattctgtgcaaaagntacttggacgctaggccgtgaccacgtgggggaccaggggacccctggg

SEQ ID NO: 364088 - DNA, 646 bp, Homo sapiens
  misc_feature: GZ8MTXP02G85Q6.10.30.C08.1.454.CMB.2.raw
  modified_base (387)..(387): a, c, t, g, unknown or other
  modified_base (478)..(478): a, c, t, g, unknown or other
  modified_base (483)..(483): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctatttaaaggtgtcctctgtgaagaactattagtggaatcgtgggggagccttggtacagcctggcgggtccctgagactctcctgtacagtctctggattcacctctgatgattatgccatgcacgtcgggtccgacaagccgtaccggaggggaagggccgtgggaggtcggggtactcgtggaactctaacttacaagttagtgtatttactaaatntcgcgtactcgtggtggtagggggtctttcacctatctaccgagacgacaacgcgacggacctccctactactactaaacaagtacgaacngtacngtaagaccctaggacgacgaccgttacttaagttctttacgtaggtacgtaaaccgtaaaaagtacgttaccggttaagggacggtcgttcgggaacccggtacggtaacccggacggggttccggggaaccccggtaacggggtaaccccggtttccggggg

SEQ ID NO: 364089 - DNA, 715 bp, Homo sapiens
  misc_feature: GZ8MTXP02HTO5Q.10.30.C08.1.454.CMB.2.raw
  modified_base (353)..(353): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtattttcctctttgcttaattttaaaaggtgtcctctgtagaagtaactattagtggaatcgtgggggatccgttggtacagccgtggccgggtccctgacgactctcctgtactagtctcgtgtattcacctctgatgtattatcgccatcgctacgtcgggtccgacacgccgtaccggaaggggacggtcgtagggnggttgggtctcgtaggtaactactaaacttaactaaagttaggttactttaacttttaaccgtttaaatacgttcggtacgggttacttcggttagggttacgggggtaccgggggtttcctttaccgtaccgtacttacgtacccgaagaaccgaacgaaccgtaccgaacgtaacctccctataacgtactaaagaaactacgaaaccgtagttacgtacgggaaaccgacgtaacgggaaccgtaccgtaaacggttccctttaattacgtttcgaagttaccgaaaacgaaagttccgttcgtagggccttcggcgtaacgtcgaaccgtcggggccggtaccgacggtaccgttcgg

SEQ ID NO: 364090 - DNA, 600 bp, Homo sapiens
  misc_feature: GZ8MTXP02IJO6R.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcactctgatgattatgccatgcacgtgggtccgcaagctccgaggggaaggcctggagtgggtctcgtggaatcacttacaatagtgtaattttcctaaatatgcggtactcgtggtgagggggtctttcacatctcagagacaacgcacggactcctactatctaacaaatagaactagtctagaacgtaccctagaacggacgacggtcctttagtatttctaggtacgaacaaaacgtattacgttagggacgtcgttacgggcccggttacggaacccgtacgggttacgggggaccccggtaacggggtaacccccgtttcgggg

SEQ ID NO: 364091 - DNA, 558 bp, Homo sapiens
  misc_feature: GZ8MTXP02FIN3H.10.30.C08.1.454.CMB.2.raw
  modified_base (216)..(216): a, c, t, g, unknown or other
  modified_base (274)..(274): a, c, t, g, unknown or other
  modified_base (370)..(370): a, c, t, g, unknown or other
  modified_base (431)..(431): a, c, t, g, unknown or other
  modified_base (500)..(500): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggganccttggtacagcctggcgggtccctgagactctcctgtacagtctctggattcacctntgatgattatgccatgcactggggtccggcaagctaccgaggggaaggcctggagtgggtctcgtggaatcacttacaatgtgatttacctaaatntgcgtactctgtgagggggtctttacacctatctccagagacaacgccaggaacctccctntactctaaacaaagtgaacagtctgacgacctggagacacggtccttatacttcagtgacaaaaacgtntacgtaggacgcgtcggccgtacgaccgacggtcggggaccgaacgggtacccgtggg

SEQ ID NO: 364092 - DNA, 602 bp, Homo sapiens
  misc_feature: GZ8MTXP02GUCHC.10.30.C08.1.454.CMB.2.raw
  modified_base (219)..(219): a, c, t, g, unknown or other
  modified_base (409)..(409): a, c, t, g, unknown or other
  modified_base (417)..(417): a, c, t, g, unknown or other
  modified_base (434)..(434): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctcttttgctattttaaaaggtgtcctctgtgaagaactattagtggaatcgtggggganccttggtacagcctgggcgggtccctgagactctcctgtacagtctctggattcacctctgatgattatgccatgcacgtggggtccggcaagctaccgaggggaagggcctgggagtgggtctcgtggaatctacttacaatagtgtatttacctaaatatgcgactcgtggtgagggggtctttcacntctcaganacaacgccagactcctntactctaacaaatacgaactagtctagacgaccgtgaacgacgacggtaccttagttactttcgtagtacgacgtaaaacgtagttacgttaggacgtcgttcgggaacccgttacggaacccgtacgggtacgggggaccctaaccgggggtaaccccgtttcgggg

SEQ ID NO: 364093 - DNA, 654 bp, Homo sapiens
  misc_feature: GZ8MTXP02HAX0U.10.30.C08.1.454.CMB.2.raw
  modified_base (217)..(217): a, c, t, g, unknown or other
  modified_base (362)..(362): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacagtctctggattcacctctgatgattatgccatgcactgggtccgcaagccctacggaggggacggcgtgggaggtgggtctcgtaggaactacgtaaccttaanaaagttagtagttactttaactaaatgtcgcggtactgtggtagggcgggggttcttacgactgtctacgagacgaacacgacgaacgtacctccctactactactaaaacaaagttacgaactacgttacgtacggaacgtacccgaggtaacggaccgaaccggttacctttaatttacgtttacgtagtacggaaaactaaaaacgtgttaccgtaagggtcgccggttcggaaccggtaccgaaacgtccgggggtaccggaccggtaaaccgggtacccggttcggg

SEQ ID NO: 364094 - DNA, 648 bp, Homo sapiens
  misc_feature: GZ8MTXP02H507X.10.30.C08.1.454.CMB.2.raw
  modified_base (222)..(222): a, c, t, g, unknown or other
  modified_base (383)..(383): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtattttcctctttgcttaattttaaaaggtgtcctctgtagaagaactattagtggaatcgtggggganccttggtacagcctgggcgggtccctgagactctcctgtacagtctctggattcacctctgatgtattatcgccatgcacgtcggggtccgacaaacggcctaccggaaggggaaacgggccgtaggggaggtcggggtctcgtaggaaactcgaacttanaagtacgtagtactttactaaaatgtgcgtactgtgtgggtacggggtctttacaccgacttcgaccagaacgaacaaccgacgaacggtaccctcctactactactaaacaaatagaaactagtctacgaacgtaccgaggaacggaacgtaccggtacctttaagttactttacgttggtaaacgaacgaaaaagtccttacgttaggacgtcgtcggtccgacgaccgtacggcgggaccgtaaccgggtaaccgttccggg

SEQ ID NO: 364095 - DNA, 601 bp, Homo sapiens
  misc_feature: GZ8MTXP02J0PZQ.10.30.C08.1.454.CMB.2.raw
  modified_base (450)..(450): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggagccttggtacagcctggcgggtccctgagactctcctgtacagtctctggattcacctctgatgattatgccatgcactgggtccggcaagctccgagggaaggcctggagtgggtctcgtggaatcacttacaatagtgtatttaccttaaatatgcggactcgtaggtgagggggtctttcaccatctccagagacaacgccaggaacctccctctactcaacaaatgaaacngtactcgaagacctaggaacggtacgacggtacccttaattactttctaggttagaacaaaagtactacgttagggaacgtcgtcgggtcccggttacgaccccgtaacgggtccgggggaccgtaaccgggggaaaccccgtttcggggg

SEQ ID NO: 364096 - DNA, 576 bp, Homo sapiens
  misc_feature: GZ8MTXP02JZY0O.10.30.C08.1.454.CMB.2.raw
  modified_base (218)..(218): a, c, t, g, unknown or other
  modified_base (259)..(259): a, c, t, g, unknown or other
  modified_base (337)..(337): a, c, t, g, unknown or other
  modified_base (355)..(355): a, c, t, g, unknown or other
  modified_base (384)..(384): a, c, t, g, unknown or other
  modified_base (429)..(429): a, c, t, g, unknown or other
  modified_base (434)..(434): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggganccttggtacagcctggcgggtccctgagactctcctgtacngtctctggattcacctctgatgattatgccatgcactgggtccggcaagctccgaggggaggcctggagtgggtctcnggaatcacttacaatgtntatttacctaatatgcggactcgtgtggngggggtctttcacatctcagagacacgcagactcctctatactanaaatnaacagtactgacgacctggacggacgaccggtacctttatatttccgtgttacgacgaaaagtctagttacgggacgtcgttcgggccgttacggaacccgtacgggtcgggggacccgtaaccggggtacccgtttcgggg

SEQ ID NO: 364097 - DNA, 589 bp, Homo sapiens
  misc_feature: GZ8MTXP02HPD35.10.30.C08.1.454.CMB.2.raw
  modified_base (217)..(217): a, c, t, g, unknown or other
  modified_base (285)..(285): a, c, t, g, unknown or other
  modified_base (387)..(387): a, c, t, g, unknown or other
  modified_base (396)..(396): a, c, t, g, unknown or other
  modified_base (417)..(417): a, c, t, g, unknown or other
  modified_base (446)..(446): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctggggganccttggtacagcctggcgggtccctgagactctcctgtacagtctctggattcacctctgatgattangccatgcactggggtccgcaaagctccgagggaacggtcctagggagttggggtcctcgtggaaacttcaacttacaatagttgattttacctaaattacgngcggtactntgtggagggggtctttcacgntctccagagacaacgccaacgactccctntactactaacgaaatgaaactagtatagacgacgtgacggacacggtcttaatacgtttctaggtacgacaaaagtactacgttacggagtcgtcggtccgtcggaaccgacggtacggggcccgtaacgggtaacccgtcgg

SEQ ID NO: 364098 - DNA, 681 bp, Homo sapiens
  misc_feature: GZ8MTXP02FLINS.10.30.C08.1.454.CMB.2.raw
  modified_base (279)..(279): a, c, t, g, unknown or other
  modified_base (284)..(284): a, c, t, g, unknown or other
  modified_base (289)..(289): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggccgggtccctgagactctcctgtacagtctctggattcacccttntgatnattangcatgcacgtcggggtccgacgaacgcgtacggaaggggaacggggcgtggggaggtcgggtctcgtagaactactaaacttaaactaaagtagtagtaacttttaacttaaaagtagtcgcggtactcgtggtaggggtacgggggtcttacactactcgtacgagaacgaacgaacgacgaacgtaacctaccctactaactactaaaactaaacgtaacgtaaacgtacgtacgtacgtaacgtaccgtacggaacggtaaccgtacgttacttaacgttacgttacgtacgtacgtaaacgtaaaaacgtcgttacggtcggtacggtcgtacggtaaccggtacgtaaccgtacgggtaccgggaccggtaccgggtacccggtcgg

SEQ ID NO: 364099 - DNA, 658 bp, Homo sapiens
  misc_feature: GZ8MTXP02GGV19.10.30.C08.1.454.CMB.2.raw
  modified_base (218)..(218): a, c, t, g, unknown or other
  modified_base (276)..(276): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggganccttggtacagcctggcgggtccctgagactctcctgtacagtctctggattcacctntgatgattatgccatgcacgtcgggtccgcaagcctaccgaggggaacggccgtgggaggtgggtctcgtggaactcaacttaacaagttagtagtattttaccttaaaatacgttgcggtactcgtggtgggacgggggtctttcgacctagtcctacccgagacgaaccgaaccgacccacgggtaacccttcccccgttacttaatacctaaactaaaatcgaaactacgtacgtaggaaccgacgtacggacgaccgtaccggtactttacgttactttaccgtagtacggaactaaaagtacgttacgttaggacgcggttacggccggttacgaccgtacggtacggggaccgtaaccggggtacccgtttcgggg

SEQ ID NO: 364100 - DNA, 620 bp, Homo sapiens
  misc_feature: GZ8MTXP02F9FRJ.10.30.C08.1.454.CMB.2.raw
  modified_base (286)..(286): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctcttgctattttaaaaggtgtcctctgtgaagaactattagtggaatcgtgggggagccttggtacagcctgggcgggtccctgagactctcctgtacagtctctggattcacctctgatgattangccatgcacgtgggtccggacagctccgaggggaggccgtggaggtgggtctcgtggaactcgacttacaaattacgtagtactttaccttaaatacgttgcggtactcgtgtgggaggggtctttcacatctccagagacaacgccaggacctcctctactactaaacaaatacgaactagtcgtagacgtacccgtggaacggaccgtaaccgggtaccttaagttaactttcctaggtacgtaaacgtaaaaagtcttacgttaggacgtcgtacgggtccgtacggaccgtaccgggtcgggggacccgtaacgggtaacccgtttcggg

SEQ ID NO: 364101 - DNA, 642 bp, Homo sapiens
  misc_feature: GZ8MTXP02HJ978.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtgggggagccttggtacagcctggcgggtccctgagactctcctgtacagtctctggattcacctctgatgattatgccatcgcacgtcggggtccgcaaacgcctacggaggggacggcctgggagtgggtctgtaggaatctacttacaatagtagtactttaccttaaatagtgccggtacttcgtggtagggacgggggttccgtttacaccgtacttcctacccgaagaacggaccgaaaccgaccgaacggtaaccctccctactactactaaacaaagttacgaacgtagtacgtagacgtaccgtaggacgaccgtacggttaccttagttattcgtagtacgaacgtaaaacgtattacgttaggacgtcgtcggaaccgtcgaccgtaccggacgggacccgtaaccgggtaccgttcggg

SEQ ID NO: 364102 - DNA, 749 bp, Homo sapiens
  misc_feature: GZ8MTXP02IY3XY.10.30.C08.1.454.CMB.2.raw
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggcgggtccctgagactctcctgtacagtctctggattcacctctgatgatatgccatgcacgtcgggtccgacaagcctaccgaaggggaacggccgtgggaggttgggtctcgtaggaactcgaacttacaattagtacgtaacttttaccttaaaattagtcgtcgggtacttcgttagggttagggacggggggttcctttaccgaacccgtacgtcccgttaccgaacggtaacgaaacccgaaacccggacccgaaaccggggtaaaccccttacccccttaacttaaaccgttaacctaaaaccgtaaaacgttaacgaaaaccgttacgttaccgtacggaacgtaaccccgttaggaaacgggacgtaaccggttaccttaacgttactttcgtagtacgaaaccgtaaaacgtagttaccgttaggtaacgtccgttacgggccggttaacggtaccgtaccgggttacggggaacccggtaaccggggtaaacccggtttccgggg

SEQ ID NO: 364103 - DNA, 686 bp, Homo sapiens
  misc_feature: GZ8MTXP02GL38M.10.30.C08.1.454.CMB.2.raw
  modified_base (375)..(375): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctggccgggtccctgagactctcctgtacagtctctggtattcacctctgatgattatcgccatgcacgtgggtccgcaagcctccgaagggacggcgtggagtgggtctgtggaatcaacttacaatagtatatttactaaatntgcgtactcgtggtggcgggggtctttacacctatcctaccagaacgaacctaaccgaccacggtaaaccctcccctactaactactaaactaaatacgaaacgtagtaccgtaggaaacgtacccgtagggaaccggtaaccgtaccgggttacccctttaagtttaactttcgttacggtacgttaaaaccgaaaaaggttcttaccggttaggggtaaccgtccgggtttacgggaacccggttacgaacccggtaccgggttccgggggaaccccggtaaccgggggtaaccccggtttcccggggg

SEQ ID NO: 364104 - DNA, 826 bp, Homo sapiens
  misc_feature: GZ8MTXP02JI5P6.10.30.C08.1.454.CMB.2.raw
  modified_base (219)..(219): a, c, t, g, unknown or other
tcagcatagtagtgcacgaccggtgctcgatttagtctgacgtcaaagggaaaggggtgggaaaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtggggganccgttggtacagccgtgggcgggtccctgacgactctcctgtacagtctctggtattcacctctgatgattatgccatcgccacggtcggggtcccggacaacgccgtacccggaagggggaacggggtcccgtaggggtacgggttcggggttcccgttacgttaagggtaaaccttacctaaaccgtttaaacgtaaagttaacggtttacgttaacctttttaaacccttaaaagtttacgttacgggtaccgggttaccttaccgggttaggggttacgggggttacggggggttcccgttttaccgtaacccgtacgttacccgtacccgaaaggaaccgaaacccgaaccggaccccgtaaacgggtaaaccccttacccccttactaacgttacctaaactaaaacgtacgaaaccttacggtctaacgggtaaccgtaccgtaggaacggtaccccgtacggttacctttaagttaacgtttcgaacgttacggtaaacctaaaaggttacgtggttacggacgtaccggttgggacccggtggtaaccccgtcgggtaccgggggacccgtaaccggggtacccgtttggtaccccgg

SEQ ID NO: 364105 - DNA, 599 bp, Homo sapiens
  misc_feature: GZ8MTXP02J3KK5.10.30.C08.1.454.CMB.2.raw
  modified_base (220)..(220): a, c, t, g, unknown or other
  modified_base (490)..(490): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctcttttgcttaattttaaaaggtgtcctctgtgaagaacttattagtgaatcgtgggganccttggtacagcctgggccgggtccctgagtactctccctgtacagtctctggattcacctctgatgattatgccatgcactggggtccgcaaacggctccgaggggaaggccgtaggagtggggtctgtggaatacgacttacaatagtgtactttaccttaaatacgtggcggtaactctggtgtagggggtcctttacgacccatctacagacgaaccgaacgccgaaggaacctccctacttatctaacaatagactagtctaganaccgtgagaccgacggtaccttagtactttctagtagacaaaagcttcgttaggacgtcgtcgggcgtacgacctacggtcgggaccgtacgggtaacccgtttccggg

SEQ ID NO: 364106 - DNA, 859 bp, Homo sapiens
  misc_feature: GZ8MTXP02IVV1S.10.30.C08.1.454.CMB.2.raw
  modified_base (258)..(258): a, c, t, g, unknown or other
  modified_base (287)..(287): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtgggggagccttggtacagcctggcggtcctgagactctcctgtacngtctctggacttcacctctgatgtattancgccatcgctaccgtcggggtccgacaaggccgtaccggacggggaaacgggtcccgtaggggaggttcggggttaccctcggtacgggtaaaacttccgtaaaccgttttaaccgtaaaagtttacggttagtttaactttttaaccccgttttaaaaagttaccgttagggtacccgggggttaaactttcccgggttgggttacgggggttaaccgggggggggttcctttttaccgaaaccccgttagttcccgtacccgaaacggtaacgaaaccgaaacccggacccgtaaaccgggtaacccttaccccttaccttaacttaccttaaaaccgtaaaacgttaacgtaaaaccgtagttacccgttaggaaccgtaacccgttacggaaacgggtacccgtaaaccgggttaccctttaaagtttactttacggttacgttacggtaaaacgtaaaacggttaaacgttcggtttacgggacgtccggttacgggtaaccggtacggtaacccggtaccgggtaccgggggtacccggtaaaccggggtaaccccggtttcgggg

SEQ ID NO: 364107 - DNA, 628 bp, Homo sapiens
  misc_feature: GZ8MTXP02GMPMD.10.30.C08.1.454.CMB.2.raw
  modified_base (479)..(479): a, c, t, g, unknown or other
  modified_base (494)..(494): a, c, t, g, unknown or other
  modified_base (561)..(561): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtattttcctctttgctaattttaaaaggtgtcctctgtgaagaactattagtggaatcgtgggggagccttggtacagcctggcgggtccctgagactctcctgtacagtctctggtattcacctctgatgtattatgccagtgcacgtcggggtcccgcaacgctcccggaaggggaacggccgtgggaggttcggggtcttacgtgaactctaactaactaagtagtagttactttaaccttaaatagtgcggtactcgtggtgggaggggttctttacgactatcctaccgaagacgaaccaacgccgaacgtacctaccctntactactaaacaaanagtaacagtctaggacaccgagacgacctaacggtccttattacgttctaggacgacgtaaaacgtntccgttaggacgtcgtcgggcgttaccgacgtacggaccggggacgtaccggggaaccgtttccggg

SEQ ID NO: 364108 - DNA, 615 bp, Homo sapiens
  misc_feature: GZ8MTXP02JQRAS.10.30.C08.1.454.CMB.2.raw
  modified_base (394)..(394): a, c, t, g, unknown or other
  modified_base (425)..(425): a, c, t, g, unknown or other
  modified_base (539)..(539): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaggtgtcctctgtgaagaactattagtggaatcgtgggggagccttggtacagcctggcgggtccctgagactctcctgtacagtctctggattcacctctgatgtattatcgaccatcgcgacgtcggggtccggacaacgcgtaccgaaggggaacggccgtgggaggtgggtctcgtggaactcacttacaacgtagtgtactttaccttaatagngtcggactcgtggtgagggggtctttcactntcctcagagacaccgcgacgactccctatactactaacaaatacgaacagtactaggacgtaccgtaggacggaccacggtaccttattacttcgtagtacgtaactaaaagtnttacgtaggaacgtcgtagggcccggtacgaccgtaccgggtacgggggacccgtaacgggggtaacccttcgggg

SEQ ID NO: 364109 - DNA, 595 bp, Homo sapiens
  misc_feature: GZ8MTXP02GHHS3.10.30.C08.1.454.CMB.2.raw
  modified_base (219)..(219): a, c, t, g, unknown or other
  modified_base (270)..(270): a, c, t, g, unknown or other
  modified_base (379)..(379): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttattttaaaaggtgtcctctgtgaagaactattagtggaatcgtggggganccttggtacagcctgggcgggtccctgagactctcctgtacagtctctggnttcacctctgatgattatgccatgcacgtggtccgcaagctccgaaggggaggccgtggagtgggtctcgtaggaactgaacttacaatagtgtaatttaccttaaatncggtcggtactcgtggtgggagggggtccgtttcaccgtatcctacagagaccgaacgtccagaacctccctacactactaacaaatacgaactagtactagacgtaccgtaggacgaccgacgtctttaagtctttgcgtagaaacaaagtattcgtaggacgcgttcggaaccgttcgaccgtacggtacgggacccgtacggaaccgttcggg

SEQ ID NO: 364110 - DNA, 742 bp, Homo sapiens
  misc_feature: GZ8MTXP02F10WA.10.30.C08.1.454.CMB.2.raw
  modified_base (294)..(294): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggtattttcctctttgctattttaaaaggtgtcctctgtgaagaactattagtggaatcgtgggggagccgttggtacagccgtgggccgggtccctgagactctcctgtacagtctcgtggtattccacctctgatgattancgccatgcacgtcggggtccggacaacggccgtaccggaaggggaacgggtccggtggggtacggttcggggtctcggttaggtaaacttcctaaactttaacgaaagttacggttagttaactttttaacctttaaaagttacgttacggccggggtaaccttcggttaggggttagggggtacggggggttccgtttttaccgacccttaacgttcccgttaacccgaaggaacgtaaaccgaaacccgaccgaaccgggtaaaccccttccctacttaactacctaaaaccgtaaatacgaaaccgtacgtactacggaacgaccctagggaacggtaaccgaccggttctttaagttactttcgtagtacgaaactaaaagtctacgttaggacgtcgtacggcgtacgaccgtacgggcgggtaccgacgggtaccccgttgg

SEQ ID NO: 364111 - DNA, 689 bp, Homo sapiens
  misc_feature: GZ8MTXP02G8DSG.10.30.C08.1.454.CMB.2.raw
  modified_base (293)..(293): a, c, t, g, unknown or other
  modified_base (540)..(540): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctaattttaaaaggtgtcctctgtgaagaactattagtggaatcgtgggggagtccttggtacagccgtgggccgggtccctgacgtactctcctgtacagtctctggacttcacctctgatgattntgccagtcgctacgtcgggtccggacaacgccgtaccggaggggtaacgggtcccgtaggggacggtttcggggtccttacggtacggtaaactctaaacgtttaaccaaagttacgttagttacctttaaccttaaaatacgtcgtcggtacttcggtggtacggggtagggggttctttaccaactaccttcaccgaagacgacacccgacgacgacctaccctatacactaaacaagtagaacngtacctagaccgtacgtagaacggtacgtacccggtactttaagttacgttcttaggtacgtaaacgtaaaagtcgttacgttacggacgtccgttacggccgtacgaacccgacgggtaccgggaccgtaccgggtaaccgttccggg

SEQ ID NO: 364112 - DNA, 673 bp, Homo sapiens
  misc_feature: GZ8MTXP02IWXEQ.10.30.C08.1.454.CMB.2.raw
  modified_base (335)..(335): a, c, t, g, unknown or other
  modified_base (370)..(370): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtgggggagccttggtacagcctgggcgggtccctgagactctcctgtacagtctctggattcacctctgatgtattatgccatgcgacgtgggccgacaacgctccgaggggaacgggcgtgggnggtgggttctcgtggtaatctactactaagtagtntatttacttaaatatagcggtactcgtggtgggtacgggggtctttacgacctacttccgtaccaagtacgaaccgacccgacgtaccgtaaccttacccctactactactaaacctaaagtacaactacggtcaggaacgtaccgtagggaacggaccgtaacggttacctttaagttctttacgtaggtacgtaaagtaaaacgttacgttacgtttacggaacgttcgttaccggggcccgtacggtacccgtaccgggggaccggggtacccggtaaccgggtaacccggtttccgggg

SEQ ID NO: 364113 - DNA, 680 bp, Homo sapiens
  misc_feature: GZ8MTXP02GLA33.10.30.C08.1.454.CMB.2.raw
  modified_base (220)..(220): a, c, t, g, unknown or other
  modified_base (279)..(279): a, c, t, g, unknown or other
  modified_base (288)..(288): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgcttaattttaaaaggtgtcctctgtgaagaactattagtggaatcgtggggganccttggtacagcctggcgggtccctgacgactctcctgacagtctcgtggattcacctngatgattangccatcgcacgtgggtccggacaagcctaccggaggggacggtccgtgggacggttcgggtctcgtaggtaatctaacgttaacattacgtgtatttaccttaaatacgtgcgtactcgtggtcggtagggggtcctttacaccgtatcgtacgagacgaacaacgccgaacggtaaccttcccgtacttaactacctaaactaaaagttacgaaacgtacgttacgtaacggaacgtaacccgttaggaaaccggtaaccgtaacgggttaccttaagtttaactttaccggtaggtacgtaaacgtaaaagtaccttacggtaggtaacgtcgtacggtaaccgacgaaccgtacggtaccggggacctaacgggggtacccttccgggg

SEQ ID NO: 364114 - DNA, 702 bp, Homo sapiens
  misc_feature: GZ8MTXP02I0OGC.10.30.C08.1.454.CMB.2.raw
  modified_base (218)..(218): a, c, t, g, unknown or other
  modified_base (521)..(521): a, c, t, g, unknown or other
tcagcatagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatcgtggggganccttggtacagcctgggcgggtccctgagactctcctgtacagtctctggtattcacctctgatgattatgcctatgcacgtgggtccgacacgcctaccggaaggggacggccgtagggacggttgggtctcgtaggtaactcaaacgttaacaagttagtacgttaactttaccttaaaatacgtggcggtacttcgttagggtacgggacgggggttctttaccaccctatacccgtacgaacgacgaaccgaacccgacgtaaccggtaacccttaccccttactaactaccttaaaanaaaacgttacgaaaactacgttcctaggaacggtacccgtaggaaccgggtaccgtaacggtcctttaagttacgttacgtaggtacgaaacgtaaaagtctttaccggtgaaccggtcgtacggtcccggtacgtaccgtaacgggccggggaaccgttaccggggtaaccctttcgggg

SEQ ID NO: 364115 - DNA, 524 bp, Homo sapiens
  misc_feature: GZ8MTXP01EE5NO.4.6.A06.1.454.CMB.2.raw
  modified_base (319)..(319): a, c, t, g, unknown or other
  modified_base (361)..(361): a, c, t, g, unknown or other
  modified_base (419)..(419): a, c, t, g, unknown or other
  modified_base (491)..(491): a, c, t, g, unknown or other
  modified_base (503)..(503): a, c, t, g, unknown or other
  modified_base (521)..(521): a, c, t, g, unknown or other
  modified_base (523)..(523): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtcaagaatcagttctccctgaggctgacctctgtgaccgccgctgacacggcccgtctattactgtggganacagtgcagtggtggttcgtgcccccccgagtactggggccnggaaatcttggcaccgtctcctcagcctcaccagggcccatcggtcttcccctggccnccctgctccaggagccaccgtccgagacgcacagccggcccgtgggctgcctggtcaaggcttacttcccanagtgcttcttgngcgggctgggcaggccgngng

SEQ ID NO: 364116 - DNA, 530 bp, Homo sapiens
  misc_feature: GZ8MTXP01EONGN.4.6.A06.1.454.CMB.2.raw
  modified_base (308)..(308): a, c, t, g, unknown or other
  modified_base (356)..(356): a, c, t, g, unknown or other
  modified_base (453)..(453): a, c, t, g, unknown or other
  modified_base (510)..(510): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtggagcccagctacaatccctcctcaagagtcgactcaccatctcggctgacccgtcaagaatcagttctccctgaggctgacctctgtgaccgccgctgacacggccgtctattacngtggagacagtgcagtggtggttcgtgcccccccgagtactggggccncggaaatcttggtcaccgtctccctcagcctccaccaagggcccagtcgtcttcccctggccgccctgctccaggacgcaccgtccgagacgccacncgcggccctggggcctgccctggtcaagggcttactccccttaagcgtgcttcttgngcgggctggcaaggcgcaag

SEQ ID NO: 364117 - DNA, 526 bp, Homo sapiens
  misc_feature: GZ8MTXP01A5RS5.4.6.A06.1.454.CMB.2.raw
  modified_base (326)..(326): a, c, t, g, unknown or other
  modified_base (360)..(360): a, c, t, g, unknown or other
  modified_base (451)..(451): a, c, t, g, unknown or other
  modified_base (459)..(459): a, c, t, g, unknown or other
tcagagcactgtagcacgaccggtgctcgatttagatctactgacaggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgttctggatgcagctccaacatcggaggacatcctgtgagctggtaccaacaccctcccaggaaccggcccccaaactcctcatctatacagtattctaagacggcccncgacggggtcccagactcgattctctggcctccnggtctgggcaccctcacgccctccctgtccatcagtgactccggtctggagatgaggctgacttactatttgtcaggagtgggtattacgngtccctanatgctcggctggttcgggcggtagggaccaagttcgaaccgtgttaaggcagcccaaggcctcccgg

SEQ ID NO: 364118 - DNA, 618 bp, Homo sapiens
  misc_feature: GZ8MTXP01DPVLP.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggaggcagctccaacatcggagacatcctgtgagctacggtaccaacaccctcccgaaggaacccggcccccaaactccctcacttctaactaaccagtacttactaaacggacggccccgagacggggtccccagactccgacttctctcggcctccgaggtctggccacctcacgccctcctgtcccatcgaggtcgtaccgttccggtctgaggagtgacggtctagacttacgttagtttggttacgaggtagttgggtaactttacgaacgtcctaactgtcgtccgtcggtcgttcgggttcgggacggtaacgggtaaccttaaacgttcggttaacccgttgttaacggtccgacggacccgttacggtcccgttcccggtcccccg

SEQ ID NO: 364119 - DNA, 536 bp, Homo sapiens
  misc_feature: GZ8MTXP01AZT47.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgttctggaggcagctccaacatcggagacatcctgtgagctggtaccaacacctcccaggaaccgcccccaaactcctcatctatacagattctaagacggcccgcgacgggggtcccagactccgattctctggcctccaggtctcggccaccctcacgccctccctgtccatcagtcggacctccggtactgagatggagctgactacgtattgttcaggtatggattacgacgcctacatcgctcggcttggttcggcggtaacgggaccaaacgttgaccgtcttaggtcacgcccaagtccttccgtcccccg

SEQ ID NO: 364120 - DNA, 841 bp, Homo sapiens
  misc_feature: GZ8MTXP01BN2FU.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaacatcggagacatcctgtgagctggtaacccaacaccctcccgaacggaaccccggaccccccaaaactccctaccaacttacctaacttaaccgagtactttaccgtaaaacgggaccgggcccccggacggaaccgggggtccccaaggtacttcccggaactttcgtcgttcgggcccttacccgaagggtccgttcgggaccctaaccccttccgaccggtcccccttcccccgttcggttaccccaaacgtttccggaaacgggttccggggtaaccccgtttccccggggttaccgttacggggaacggggtagttacgggaacggggtcccttaagggttaaacccctttaacggtttaagttttcgggtttaaccgaagggggttaacgttgggggtaaacttttaaccggaacggtccccttaaagtacgttcggtccgttccggggtcgtttcggggtttaccggggaccgggggtaaacggggtaaaccccttaaaacggttccgggttaaaccccgggtttaacgttttaaccggggtaaccgtaaccggaccccggttaaacggggtccccgttaaccccggtcccccccggg

SEQ ID NO: 364121 - DNA, 534 bp, Homo sapiens
  misc_feature: GZ8MTXP01BHMB1.4.6.A06.1.454.CMB.2.raw
  modified_base (262)..(262): a, c, t, g, unknown or other
  modified_base (310)..(310): a, c, t, g, unknown or other
  modified_base (317)..(317): a, c, t, g, unknown or other
  modified_base (360)..(360): a, c, t, g, unknown or other
  modified_base (380)..(380): a, c, t, g, unknown or other
  modified_base (503)..(503): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctcctcaagagtcgactcaccatctcggctgacccgtcaagaatcagttcnccctgaggctgacctctgtgaccgccgctgacacggccgtctattacngtggganacagtgcagtggtggttcgtgcccccccgagtactgggggccncggaaatcgttggcaccgtntccgtcagcctccaccaaggcccatcggtcttcccctggccgccctcgctccaggacgcaccgtccgagacgcacagccggccctggggctggccctggtcaagggcttactcccttacagtncgttcttgaagcgggctgggcaaggcgcaag

SEQ ID NO: 364122 - DNA, 540 bp, Homo sapiens
  misc_feature: GZ8MTXP01D9NZY.4.6.A06.1.454.CMB.2.raw
  modified_base (318)..(318): a, c, t, g, unknown or other
  modified_base (359)..(359): a, c, t, g, unknown or other
tcagagcactgtagcacgaccggtgctcgatttagatctactgacagggtcccccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctcctcaagagtcgactcaccatctcggctgacccgtcaagaatcagttctccctgaggctgacctctgtgaccgccgctgacacggccgtctatttactgtggganacagtgcagtggtggttcgtgcccccgagtacgtggggccncggaatcttgggtccaccgtctccctcacgccctccaccaacgggcccatccggtcttccccgtggccgccctgctccgagacgcacctccgggagacgcacgacgccggccctgggctgccctggtcaaggaactcttccctacagtgcttcgttgagcgggctggcaggcgcgaataag

SEQ ID NO: 364123 - DNA, 537 bp, Homo sapiens
  misc_feature: GZ8MTXP01B7WFQ.4.6.A06.1.454.CMB.2.raw
  modified_base (198)..(198): a, c, t, g, unknown or other
  modified_base (470)..(470): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatcctctcttgttctggaggcagctccaacatcggagacatcctgtgagctggtacccaacaccctcccaggaaccggcccccaaatccctcatcctatacagattctaagacggccccgcagggggtccccagactccgatttctctggcctcccagggtctgggccacctcacgcctccctgtccatcagtcgactcggtctgaggatgagctgacttacgtatttgttcaggtatggattacgagtcctacatgctcggtnttggttcggcggtacgggaccaaacgttgaccgtcgttacggtcacgcccaggtccttcgtcccccg

SEQ ID NO: 364124 - DNA, 586 bp, Homo sapiens
  misc_feature: GZ8MTXP01BWRT4.4.6.A06.1.454.CMB.2.raw
  modified_base (200)..(200): a, c, t, g, unknown or other
  modified_base (357)..(357): a, c, t, g, unknown or other
  modified_base (417)..(417): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggccccccggnagagggtcatcctctcttgttctggaggcagctccaacatcggagacatcctgtgagctaggtacccaacaccctcccaggaacccgacccccaaactcctcatctatacagtattactaagacggcccgacgacgggggtcccagactccgattcncgtggcctacccgagtctggccacctcacgccctcctgtccatcagtgactcgtctgagntgagctagtactacgtattgttcgaggtagtgggtatttacgacgtccttaacgacgttcggtcgtcgggtcgttcggggttaccgggacggggtaaacggaaccgttaacgttcggttacccgttcgttacggaacaccggaccgttacggtcccgttcccgtccccg

SEQ ID NO: 364125 - DNA, 556 bp, Homo sapiens
  misc_feature: GZ8MTXP01BKU72.4.6.A06.1.454.CMB.2.raw
  modified_base (465)..(465): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggcagagggtcatcctctcttgttctggagcagctccaacatcggagacatcctgtgagctggtaccaacacctcccgaggaaccggcccccaaactccctcactctatacagtattctaaagcggcccgcgacgggggtcccagactccgattctcgtggcctccgaggtctggccacctcacgtccctccctgtccatcagtcggacctccggtctgaggatgagctgtactacgttattgttcaggtagtggattacgacgcctanagtcgcgtcggtcttcggttcggcgggacgggaaccaacgttcggttaccgtcgttacggtcgacgcccgaacggtccgttcggtcccccg

SEQ ID NO: 364126 - DNA, 570 bp, Homo sapiens
  misc_feature: GZ8MTXP01ALPSV.4.6.A06.1.454.CMB.2.raw
  modified_base (199)..(199): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggnagagggtcatcctctcttgttctggaggcagctccaacatcggagacatcctgtgagctggtaccaacacctcccaggaaccgcccccaaatcctcatctatacagattcaagacggcccgcgacggggtcccagactccgattctcgtcggctaccgaggttctgggccacctcacgccctcctgtccatcagtcggactcggtctgaggatgagctgactacgtagttgttacaggtatgggtattacgacgccttacgagtcgcgttcggcttcgggttccgggcgggaacggggtaacccttaaacgttcggacccggttcgtttacggcaccggcccgttaacggtccgttaacccggtccccccg

SEQ ID NO: 364127 - DNA, 549 bp, Homo sapiens
  misc_feature: GZ8MTXP01D11JN.4.6.A06.1.454.CMB.2.raw
  modified_base (259)..(259): a, c, t, g, unknown or other
  modified_base (319)..(319): a, c, t, g, unknown or other
  modified_base (443)..(443): a, c, t, g, unknown or other
  modified_base (458)..(458): a, c, t, g, unknown or other
  modified_base (472)..(472): a, c, t, g, unknown or other
  modified_base (511)..(511): a, c, t, g, unknown or other
  modified_base (515)..(515): a, c, t, g, unknown or other
  modified_base (522)..(522): a, c, t, g, unknown or other
  modified_base (534)..(534): a, c, t, g, unknown or other
  modified_base (538)..(538): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagccccagggaagggactggaatggattgggaacacctattacagtggagcccagctacaactccctcctcaagagtcgactcaccatctcgctcgacccgtcaagatcagttcncctgaggctgacctctgtcgaccgccgctcgacaccggtccgtctattacgtggtggganacgagtgcgtagttggtcggtcgtcgccccccgaggtacgtggggccgcggtaaacttcgttcggcctaccgtctcctcacgcctaccaccgaacgggccctagtccgtccttccccgtggccncctgcctccgaggcnccaccgtcgagacncacgcgccgccgtggctcgctggcaagtcttactccagngtcncgttcgnggcggcgggtcncggnacggcgcgaag

SEQ ID NO: 364128 - DNA, 546 bp, Homo sapiens
  misc_feature: GZ8MTXP01DLDJC.4.6.A06.1.454.CMB.2.raw
  modified_base (330)..(330): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggccccccggcagagggtcatcctctcttgttctggaggcagctccaacatcggagacatcctgtgagctggtaccaacacctcccaggaaccggcccccaaactccctcatctaataccagattctaaaggacggccccgnacgggggtccccaggactcccgattctctggcctccaggtctggccacctcacgccctcctgtccatcagtcgactccggtctgagatgagctagactacgttattgttcaggtactgggtattacgacgtcctacatcgctcggtcttggttcggcggtacgggaccaacgttcgaccgttcttacggtcacgcccgaggtccttcggtcccccg

SEQ ID NO: 364129 - DNA, 683 bp, Homo sapiens
  misc_feature: GZ8MTXP01A4IJZ.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnaggagggtcatcctctcttgttctggagcagctaccaacagtcggagacactcctggtgacgcgtacggtaacccaaccaccctacccgaacggaaccccgacccccaaactccctactactctaatacagtacttacgtaacggacggcccgacgacgggggtcccagtactccgtattcgtcgtcggcctacccgaggttccgtggaccctacccgttccgaccggtcccccttccgtcgtaccctacgtacgtacgggtcggtacccgttccgggttacgtagggacggtacgttcgggacgtcgtacgtaaccgtttacgttagtttcggttacgaaggtagttacggggtactttaccgacgtcctaacgacgttcggtccgtcggtcgttcgggttccggggacggtaacggaaccgttaacgttcggttaccgttaacgtacggtcgacgtccgacggtcccgttccgtcccccg

SEQ ID NO: 364130 - DNA, 628 bp, Homo sapiens
  misc_feature: GZ8MTXP01BJVJD.4.6.A06.1.454.CMB.2.raw
  modified_base (200)..(200): a, c, t, g, unknown or other
  modified_base (237)..(237): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagcctcaantcggaggacatcctgtgagctggtaccaacaccctcccgaacggaacccgcccccaaactccctcaactctaactacaagtacttacgtaaacggacggccccgcgacgggggtccccaagtactccgatttctcgtcggcctaccgaggtcctcgggccaccctcacgtccctcccgtcgtccatcagtcggaccttccggtctaggagagtgacgtcgtacgtaacgttacttagtttcgttaccgaagggtatggggtaacttaccgacgtcctaacgtagtcggtcgtcggtcgttacgggttccggacgggtaacgggtaacccttaaacgttcggaccgttcgttacggtccgaccgtacccgacggtcccgttcccgtcccccg

SEQ ID NO: 364131 - DNA, 782 bp, Homo sapiens
  misc_feature: GZ8MTXP01BZDG2.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctcttcttgttctggaggcagcctaccaacagtcggagacatcctggtgagctacggtaacccaaccaccctacccgaacggaaccccggaccccccaaactcccctacacttacctaactaacaagtaactttaccgtaaacgggaccgggcccccgtacggaacgggggttaccccaaggtacttcccggtactttctcgtcgggccttacccgagggttccgtcgggccctacccgtccgaccggtccccttccccgtcgtaccctaacgtccgtaacggttccgggtaccgttcccgggttccgttacgggaacgggtagttcgggaacgggtccttacggtaaacctttaaccggtttaagttttcggttaaccgtaagggtaagttacggggtaactttaaccgaacggtcccttaacgtacgttcggtccggttccgggtcgtttcggggttaccggggacggggtaaaccggggtaacccttaaaaccggttcggttacccggttaacgttacgggtaaccgtacggaccccgttaacgggtcccgttaacccggtcccccg

SEQ ID NO: 364132 - DNA, 595 bp, Homo sapiens
  misc_feature: GZ8MTXP01CHJQ5.4.6.A06.1.454.CMB.2.raw
  modified_base (198)..(198): a, c, t, g, unknown or other
  modified_base (236)..(236): a, c, t, g, unknown or other
  modified_base (336)..(336): a, c, t, g, unknown or other
  modified_base (420)..(420): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatcctctcttgttctggaggcagctccaanatcggagacatcctgtgagctggtacccaacaccctcccgaaggaaccccggcccccaaatccctcaatctaataccagtattctaaaggacggccccgngacgggggtcccaggactcccgattctcgtggcctcccgaggtctggccacctcacgccctcctgtccatcagtcgactccgtntgagatggagctgacttacgtagttgttacgaggtatgggtaattacgacgtacctacgatcgcgtcgggtcgttgggtttcggggcgggtaaacggggtaccaaaccggttcggacccggtttcgttaacggttccgacggtaccccgaacgggtcccgttcccggtccccccg

SEQ ID NO: 364133 - DNA, 558 bp, Homo sapiens
  misc_feature: GZ8MTXP01AOYZK.4.6.A06.1.454.CMB.2.raw
  modified_base (200)..(200): a, c, t, g, unknown or other
  modified_base (237)..(237): a, c, t, g, unknown or other
  modified_base (326)..(326): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaanatcggaggacatcctgtgagctggtaccaacacctcccgaggaacccgcccccaaactccctcatctatacagtattcaagcggcccgngacgggggtcccagactccgatttctcgtggctacccgaggtctggccacctcacgccctcctgtccatcgagtgactccgtctgagctgagctgactacgtattgttcgaggtatgggtattacgagtcctactatcgcgtcggtcgttcgggttcgggacgggtacgggaaccttaacgttcgaccgttcgttacggtcacggtcccgaacggtccgttccggtcccccg

SEQ ID NO: 364134 - DNA, 613 bp, Homo sapiens
  misc_feature: GZ8MTXP01C2I3I.4.6.A06.1.454.CMB.2.raw
  modified_base (367)..(367): a, c, t, g, unknown or other
  modified_base (382)..(382): a, c, t, g, unknown or other
  modified_base (392)..(392): a, c, t, g, unknown or other
  modified_base (422)..(422): a, c, t, g, unknown or other
  modified_base (456)..(456): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccgggcaggagggtcatcctctcttgttctggaggcagctaccaacatcggagacatcctgtgagctaggtacccaacaccctcccgaacggaacccgacccccaaatcctacatctaactacagtattactaaacggacggccccgagacggggtccagactccgattcncgtgcctccgagtcnggccacctcncgccctcctcgtccatcagtcgacttcggntgagactgagctagacttacttgttgtcgaaggntacgggtattaacgacgtcccttaagatcggtcgtcggtcgttcgggttaccgggacggggtaaaccgggacccgttaaaaccgttcggacccggtttaaccggtttaacggtccgaccggtaccccggaacgggtcccgttcccggttccccccgg

SEQ ID NO: 364135 - DNA, 632 bp, Homo sapiens
  misc_feature: GZ8MTXP01BNWKI.4.6.A06.1.454.CMB.2.raw
  modified_base (237)..(237): a, c, t, g, unknown or other
  modified_base (334)..(334): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgttctggagcagctccaanagtcggagacatcctgtgagctggtaccaacaccctcccgaggaacccggcccccaaactcctcactctaataccagtattactaagacggccccgngacggggtcccagactccgattctcgtcggccttacccgagggttctcggacctacccgtcacgtccccgttccctcgtccctactcgacggtcggtaccgttcccggtcgtgggacggtagtggacggtctacgtaccgttaacgttagtttggttactaagggtagtggggtaacttacgtacgtcctactacgtcgctcgggtcttgggttccgggacggtaacggggaccttaaacgttcggttaccgttcgttacggccgtaacggcccgaacggtccgttcccggtcccccg

SEQ ID NO: 364136 - DNA, 598 bp, Homo sapiens
  misc_feature: GZ8MTXP01DLM2I.4.6.A06.1.454.CMB.2.raw
  modified_base (268)..(268): a, c, t, g, unknown or other
  modified_base (313)..(313): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtggagccccagctacaatccctcctcaagagtcgactcaccatctcggctgacccgtcaagatcagttctcctgagcngacctctgtcgaccgccgctgacacggccgtctattactgtgganacagtgcagtggtggttcgcgcccccccgagtacgtggggcccgcggtaaacttcgttgggtcctacccggtctccctcacgtccctcccaccgaacgggcccacgtccggtcccttcccccgtggcccgccctgcctccgaggacgccaccgtccgagacgcacgcgccggcccgtggggcctcggcccgtggtaccaaacgggtaccttaccttccccgacgtacgttcgccttcgttcggaacgggtccgggcgttacggggaccgaacgggtccgcgtaag

SEQ ID NO: 364137 - DNA, 658 bp, Homo sapiens
  misc_feature: GZ8MTXP01CAHZU.4.6.A06.1.454.CMB.2.raw
  modified_base (200)..(200): a, c, t, g, unknown or other
  modified_base (237)..(237): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagaggtcatcctctcttgttctggagcagctaccaanagtcggagactatcctgtgagctggtaccaacacctcccgaggaacccgacccccaaatccctacactctactacagtacttactaaaggacggtccgacgacgggggtcccagactccgtattcgtcgtcggcctaaccgaggttctgggaccctaccctcacgtccccttccctgtcccagtcaggtcgacctcggtactggagtatggacgtctagtacttacgttagttcgttacgaagggtacgtgggactttaacgacggtaccctaagtcgtcggccgttccgggtcgtttcggggttacccggggacggggaaacggggtaaccccaaaaccggttcggttaacccggtttcggttaacgggtccgaacccgggccccgttaaaggggtccccgttccccggttcccccccgg

SEQ ID NO: 364138 - DNA, 648 bp, Homo sapiens
  misc_feature: GZ8MTXP01AOHJR.4.6.A06.1.454.CMB.2.raw
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaactccctcctcaagagtcgactcaccatctcggctgacccgtcaagatcagttctccctgaggctgacctctgtcgacccgccgctgacacggccgtctattactgtgggagacagtgcgtagtggtggttcgtgcccccccgagtacgtcgggggccgcggaaacttcgttcgggtaccacccgttctcccgtccgacgtccccgttccccaacccgaaacggggccccctaacggttcccgggttcccttccccccgtcgggcccgtccccgtcgacctcccgaggacgcccacccggtcgacggacgccaacgcggcccggcccgtcgggggctccggtccgtcgggtaccgaaacggtacccttaccctttcccgaaactcggtcgttcccgttcgttacgggcggtcgggtccggcgggaccgagggtccgcgaag

SEQ ID NO: 364139 - DNA, 577 bp, Homo sapiens
  misc_feature: GZ8MTXP01EDF9A.4.6.A06.1.454.CMB.2.raw
  modified_base (320)..(320): a, c, t, g, unknown or other
  modified_base (366)..(366): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctcggggcccccggcagagggtcatcctctcttgttctggagcagctccaacatcggaggacatcctgtgagctggtaccaacacctcccaggaaccgcccccaaatccacatctatacagattctaagagcccgnaggggtcccagatcgtattctctggctccgaaggtctggcaccctnacgtccctcctgtcccatcagtcggactccggtctgaggatgaggtctagacttactagtttgttcgaggtacgttgggtattacgacgtacccttaatagtcgtcgtcggtcgttcgggttcgggacgggaacggtaaaccctaacgttcggttaccgttacgttaacggccgtaaccggacccgacggccgtccccggttccccgttcg

SEQ ID NO: 364140 - DNA, 600 bp, Homo sapiens
  misc_feature: GZ8MTXP01BJY2B.4.6.A06.1.454.CMB.2.raw
  modified_base (200)..(200): a, c, t, g, unknown or other
  modified_base (237)..(237): a, c, t, g, unknown or other
  modified_base (334)..(334): a, c, t, g, unknown or other
  modified_base (425)..(425): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaanatcggagacatctgtgagctggtacccaacaccctcccgaacggaacccgcccccaaactcctcactctaatacaagtattactaaaggcggcccgngacgggggtcccagactccgtacttctcgtggcctacccgagtctggccacctcacgccctcctgtccatcagtcgactcggtctgaggangagctagacgtactagtttgttacgagggtatgggtacttacgagtcctaactagtcgtcgtcgggtacgttgggttccgggcgggaacgggtaacccttaaaacgttcggttaaccccgttggtttaaccggtcgaacccggtacccgaacgggtcccgttcccggtccccccg

SEQ ID NO: 364141 - DNA, 716 bp, Homo sapiens
  misc_feature: GZ8MTXP01C4WSG.4.6.A06.1.454.CMB.2.raw
  modified_base (200)..(200): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctcttcttgttctggaggcagctaccaacatcgggaggacatcctgtgagcgtcggtaacccaacaccctacccgaacgggaaaccccggaccccccaaaacttccctaccaacttacctaataaccaggtactttacgtaaacggaccgggccccgacgtacggggggttaccccaggtacttccggtactttcctcgtcgggtccctcccgtaacgggttcctcgggccctaacccctcgaccgtccccttcccgttcgtccctactcgtacggtcggtaccgttccggtcgttaggaggtagtggacggtctacggtaacttacttaggtttcggtttacgaagggtagtacggggtacttacgacgtacctacgtagtcgtccgttcgggtcgttcgggttcggggacggggttaacgggaacccgtaaacgttcggttaccgttcggttaacggtacgtaaccggacccgtacggttcccgtcccggcccccgtttccgg

SEQ ID NO: 364142 - DNA, 527 bp, Homo sapiens
  misc_feature: GZ8MTXP01BD0GC.4.6.A06.1.454.CMB.2.raw
  modified_base (322)..(322): a, c, t, g, unknown or other
  modified_base (425)..(425): a, c, t, g, unknown or other
  modified_base (474)..(474): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctgggcccccggcagagggtcatcctctcttgttctggagcagctccaacatcggaggacatcctgtgagctggtaccaacacctcccaggaaccggcccccaaactcctcactctatacagattctaagacgcccgngacgggggtcccaggactccgattctctggctccaggtctgggcacctcagccctcctgtcccatccagtcgactcggtctgagctgagctagaccttacgtntttggtcagggatgggtattacgagcctacatgctggtcttggttcggnggacggtaccaaacgttcgaccgttgtagtcgacgccgacgtcgccgtccccg

SEQ ID NO: 364143 - DNA, 574 bp, Homo sapiens
  misc_feature: GZ8MTXP01C1R3X.4.6.A06.1.454.CMB.2.raw
  modified_base (198)..(198): a, c, t, g, unknown or other
  modified_base (234)..(234): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcacctcagcgtctcggggcccccggnaggagggtcatcctctcttgtctggagcagctcaanatcggagacatcctgtgagctggtaacccaacaccctcccgaaggaaccccgcccccaaaactccctacactctaactacaagtactttctaaaggcggccccgcgaacgggggtccccagactcccgatttctcgtggcctccgaggtctgggccaacctcacgtccctcctgtcccatcagtcgactcggctgagatgagctagactacgtattgtacaggatggacttacacgcctagtactgctcggtcgttggttcggcgggtaacgggaccttaaacgttcggttacccgtaagtttacggccacggcccgttaaggtcccgttccgtcccccg

SEQ ID NO: 364144 - DNA, 735 bp, Homo sapiens
  misc_feature: GZ8MTXP01EFLA2.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctccaccctcctcactcactgtgcagggtcctgggcccagtctgtcctgactcaggccaccctcagcgtcgtcgggcccccggnagaggtcatcctctcttgttctggagcagctcaacagtcggagacatcctgtgagcgtacggtaacccaaccaccctcccgaacggaaccccgaccccctaaactccctacacttactaactaacagtaacttacgtaaacggacggccccgacgtacgggggtaccccaaggtacttcccgtaactttcctcgtcgggtccctacccgaagggttccgtcgggtaccctaacccgtcccgtaaccggtcccccttacccgttcgtaccctacgttaccgtaacgggttccgggtacccgttcccgggttaccgttacgggtaagggtagttacgggacggtacttacgtaacctttacgttaagtttcggttacgtaggtagtgggtactttaacgacgtacctacgtagttcgtccgtcggtcgttgggttccgggacggtaaacggggtaacccttaaaacggttcgttacccggttaacgttacggtaaccgtaccgacccgttaacgggtcccttaacccggtcccccg

SEQ ID NO: 364145 - DNA, 645 bp, Homo sapiens
  misc_feature: GZ8MTXP01AFXDO.4.6.A06.1.454.CMB.2.raw
  modified_base (198)..(198): a, c, t, g, unknown or other
  modified_base (236)..(236): a, c, t, g, unknown or other
  modified_base (266)..(266): a, c, t, g, unknown or other
  modified_base (292)..(292): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcgggcccccggnagagggtcatcctctcttgttctggagcagctccaacntcggagacatcctgtgagctggtaccaacncctccgaggaaccgcccccaaatccncatctatacagtacttctaagacggcccgcgacggggtccccagactccgactttcgctcggctccgagggttccagggccacctcgacgcccctccgtcgtccatcacggtcggtaccgtccggtctcggaggtacgtaggaggtcttaggaccttaacggttagtttcggtttaccaaggggtagttaggggactttaaccggacgtcccttaacgtacgttcggcccgttcgggccgtttcgggttaccgggggccggtaaacgggggaacccttaaaccgttcgggttaaccccgttcggttacggtaaccgacgggaccccgttaaggtccgttccccggtccccccg

SEQ ID NO: 364146 - DNA, 682 bp, Homo sapiens
  misc_feature: GZ8MTXP01AWAES.4.6.A06.1.454.CMB.2.raw
  modified_base (201)..(201): a, c, t, g, unknown or other
  modified_base (240)..(240): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccggnagagggtcatcctctcttgttctggaggcagctaccaanatcggagacatcctgtgagctaggtacccaacacctcccgaggaacccgcccccaaactcctacatcctatacaagtattcaagcggcccgacgacgggggtcccagtactcccgattctcgtggcctcccgaggtctggccacctcgacgccctcctgtcccatcgacgtcggtacctccgggttacctaggtaggatacggacggtctacgtaaccgttaccgttaagtttcggtttaccgaagggttagttacgggggtaactttaaccggtaacgtacccgttaacgtacgttcgggtccgttccgggtcgttcgggggtttacccggggacggggaaccgggggtaacccttaaaccggttcggttaccccggtttaacgttacgggttcccgaacggaccccgttaacggggtcccgttaacccgggtcccccccg

SEQ ID NO: 364147 - DNA, 608 bp, Homo sapiens
  misc_feature: GZ8MTXP01BWTLI.4.6.A06.1.454.CMB.2.raw
  modified_base (201)..(201): a, c, t, g, unknown or other
  modified_base (236)..(236): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccggnagagggtcatcctctcttgtctggagcagctcaantcggagacatctgtgagctggtaccaacaccctacccgacggaacccgcccccaaactcctacactctatacagtacttctaagcggcccgcgacggggtcccagatcccgtattctcgtggctaccgaggtctggaccacctccacgtccctccctgtccatcgtagtcggtaccttccgggttactaggaggtatggacggtctgaacttacttagtttgttacgaggtagtgggtattacgacgtcctaactagtcgccgtcggtcgttcgggttcgggacgggtaacggtaacccgttaaacgttcgttaacccggttcgttacggtccgacggccccgttaacgggtcccttaacccggtccccccg

SEQ ID NO: 364148 - DNA, 676 bp, Homo sapiens
  misc_feature: GZ8MTXP01BX3DM.4.6.A06.1.454.CMB.2.raw
  modified_base (201)..(201): a, c, t, g, unknown or other
  modified_base (238)..(238): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctctcttgttctggagcagctccaantcgggagacatcctgtgagctaggtacccaaccaccctcccgaacggaaaccccggaccccccaaactccctacaactctataacagtactttcgtaaaggcggccccgagacgggggtccccagtactccgtattctcgtcggccttaaccgaggtctcgggcctaaccctcgaccgtccccttcccgtcgtcccagtccgagggtcggtaccgttcccgggtactggacggtatggacggtctagtaaccttacgttagtttggttaccgaagggtagttgggtaattaccgaacggtccctaactagttcggcgttcgggtcgttcggggttaccgggcgggtaaccggggaaccttaaaccggttcggttaacccggtttcgttaacgggtcccaaccggtacccgaacgggtccccgttcccggtccccccgg

SEQ ID NO: 364149 - DNA, 554 bp, Homo sapiens
  misc_feature: GZ8MTXP01CUBCT.4.6.A06.1.454.CMB.2.raw
  modified_base (338)..(338): a, c, t, g, unknown or other
  modified_base (401)..(401): a, c, t, g, unknown or other
  modified_base (419)..(419): a, c, t, g, unknown or other
  modified_base (424)..(424): a, c, t, g, unknown or other
  modified_base (522)..(522): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcacctcagcgtctcggggccccccggcaggagggtcatcctctcttgtctggagcagctcaacatcggagacatcctgtgagctggtaccaacacctcccaacggaacccggccccccaaaatccctacactctaataccaagtacttactaaaggacggccccgngacgggggtccccaagactcccgattctcgtggcctacgagtctggcaacctcacgccctccngtcatcagtgactcggtntgagntgagctgactactattgtcaggatggacttacgacgtcctacgatcgcgtcggtcttggttccgggcggtaaacggtaccaaaacgttcgacccgttntacggtcacgcccaaggtccttcggtcccccg

SEQ ID NO: 364150 - DNA, 664 bp, Homo sapiens
  misc_feature: GZ8MTXP01ALW8J.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnaggagggtcatcctctcttgttctggaggcagcctccaacagtcgggagacatcctgtgagctggtaaccaaccaccctacccgacggaacccggcccccaaactccctacactctaatacagtacttcaagacggccgacgacggggtccagatcccgattctcgtggcctccgagtctcggcctacctcacgcctcctcgtccatcagtcggtaccgtccggtcgtaggacggtacgtggacgtcgtacgtaccttaacggttacgtttacggttaccgtagggtaagttggggtaactttacgtaacggtacccttaagacgttcggccggttcgggtacggttcgggttaccggggacggggtaaacgggtaacccgttaaaaccggttcggttaaccccggtttggttaaccggtccgaaccgggaccccgaacggtcccgttaacccggtccccccgg

SEQ ID NO: 364151 - DNA, 568 bp, Homo sapiens
  misc_feature: GZ8MTXP01BOW0Z.4.6.A06.1.454.CMB.2.raw
  modified_base (200)..(200): a, c, t, g, unknown or other
  modified_base (237)..(237): a, c, t, g, unknown or other
  modified_base (419)..(419): a, c, t, g, unknown or other
  modified_base (444)..(444): a, c, t, g, unknown or other
  modified_base (461)..(461): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggccccccggnagagggtcatcctctcttgttctggagcagctccaanatcggagacatcctgtgagctggtaccaacacctcccgaggaaccgcccccaaatccctcatctatacagtattctaagacggccccgacgacgggggtccccaggtactccgatttctctggctacccgaggtctggccacctcacgtccctccctgtccatcagtcgactcggtctgagntgagctagactacgtattgtcaggntggattagacgtcctantgcgtcggtcttgggttccgggacgggtaacggggaacccttaaacgttccggttacccgttcgttagggtccacggacccgaacgggtcccttcccggtcccccgg

SEQ ID NO: 364152 - DNA, 598 bp, Homo sapiens
  misc_feature: GZ8MTXP01D6TZ5.4.6.A06.1.454.CMB.2.raw
  modified_base (199)..(199): a, c, t, g, unknown or other
  modified_base (299)..(299): a, c, t, g, unknown or other
  modified_base (329)..(329): a, c, t, g, unknown or other
  modified_base (428)..(428): a, c, t, g, unknown or other
tcagagcactgtagcacgaccggtgctcgatttagatctactgacagggggcttcagctgtgggtagagaagacaggactcaggacaatctccagcatggccagcttccctctcctcctccaccctcctcactcactgtgcagggtcctgggcccagtctgtcctgactcaggcaccctcagcgtcgtgggcccccggnagagggtcatcctctcttgtctggagcagctccaacatcggagacatcctgtgagctaggtacccaacacctcccgaaggaacccgacccccaaactccncatctaacacagattctaacgacggcccgngacggggtcccagactccgatttcgctggcctcccgaggtctggcaccctcacgtccctcctcgtccatcgacgtcgtaccgtcggtacgtgaggtagnggtagcgtagacttagttagtttgtacgaggtagtcgggtatttacgacgtcctactatcggctcggtcgttcggttcgggaccgggtaagggaacccaaacgttcgttaccggttaacgttaacgggtccaacggaccccggaaggtcccgttaacccgggttcccccg

SEQ ID NO: 364153 - DNA, 684 bp, Homo sapiens
  misc_feature: GZ8MTXP01BZDN0.4.6.A06.1.454.CMB.2.raw
  modified_base (199)..(199): a, c, t, g, unknown or other
  modified_base (323)..(323): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggnaggagggtcatcctctcttgttctggagcagctccaacatcggagacatcctgtgagctggtaccaacacctcccaggaaccgcccccaaactcctcatctatacagattctaagacggcccgngagggggtcccagactccgattctcgtggcctacccgaggtcctgggccaccctcacgtcccctcctcgtccactcgaggtcggaccgtcccggttaccgtaggacggtagttacggacgggtccgttacgtaacccgttaaccggtttagttttacggtttaccgtaaggggtaagttagggggtaactttaacgtaacgtacccgttaacgtacgttcggtcccgttcggggtcgttcgggtttccgggggacggggtaaccggggaaacccttaaaaccggttcggttaaccccggtttcgttaacgggtccgtaaccggaccccgttaagggtcccgttaaccccgtcccccccggg

SEQ ID NO: 364154 - DNA, 583 bp, Homo sapiens
  misc_feature: GZ8MTXP01CN305.4.6.A06.1.454.CMB.2.raw
  modified_base (261)..(261): a, c, t, g, unknown or other
  modified_base (336)..(336): a, c, t, g, unknown or other
  modified_base (358)..(358): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtggagccccagctacaatccctcctcaagagtcgactcaccatctcggctgacccgtcaagaatcagttcnccctgaggctgacctctgtcgaccgccgctgaccacggccgtctattactgtgggagacagtgcagtggtgtcgngccccccgagtacgtggggccnggaaacttcgttggtccaccgtctcctcacgccctacccacccaacgggcccagtccggtccttcccccgtggcccgccctcgcctccgaggacgccaccgtccgagcgcaacgcgtccggccgtcgggctcggcctcgggtccaaagggtccttaccgttccccttaagtacggtcgccgttcgttcggaacggcgggtcgttcgggcgaacgggccggctaag

SEQ ID NO: 364155 - DNA, 548 bp, Homo sapiens
  misc_feature: GZ8MTXP01BICD9.4.6.A06.1.454.CMB.2.raw
  modified_base (198)..(198): a, c, t, g, unknown or other
  modified_base (234)..(234): a, c, t, g, unknown or other
  modified_base (246)..(246): a, c, t, g, unknown or other
  modified_base (388)..(388): a, c, t, g, unknown or other
  modified_base (402)..(402): a, c, t, g, unknown or other
  modified_base (407)..(407): a, c, t, g, unknown or other
  modified_base (456)..(456): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctcgggcccccggnagaggtcatcctctcttgctctggagcagctcaacntcggagacatcngtgagctggtaccaacacctcccgaggaaccgcccccaaactcctcatctatacagattcaagacggcccgcgacggggtcccaggactccgattctctggctcccaggtcctgggccacctcacgtccctcctgtccatcngtggtactcggtcngaggntgagctagactacgtatttgttacaggtatgggtacttacgagtcctanatcgcgtcggtcgttggttcggcgggacggtacccgaaacgttcggttaccgtcgttacggctacggaccccgaggtccgttccgtcccccg
